(12) United States Patent
Forsyth et al.

(10) Patent No.: US 6,589,738 B1
(45) Date of Patent: Jul. 8, 2003

(54) GENES ESSENTIAL FOR MICROBIAL PROLIFERATION AND ANTISENSE THERETO

(75) Inventors: R. Allyn Forsyth, San Diego, CA (US); Kari Ohlsen, San Diego, CA (US); Judith W. Zyskind, La Jolla, CA (US)

(73) Assignee: Elitra Pharmaceuticals, Inc., San Diego, CA (US)

( * ) Notice: Subject to any disclaimer, the term of this patent is extended or adjusted under 35 U.S.C. 154(b) by 61 days.

(21) Appl. No.: 09/711,164

(22) Filed: Nov. 9, 2000

Related U.S. Application Data

(60) Provisional application No. 60/164,415, filed on Nov. 9, 1999.

(51) Int. Cl.[7] .......................... C12Q 1/68; C07H 21/02; C07H 21/04
(52) U.S. Cl. ..................... 435/6; 435/5; 435/91.1; 435/91.2; 536/23.1; 536/24.3; 536/24.5; 536/24.31; 536/24.33; 530/350
(58) Field of Search .................. 435/5, 6, 91.1, 435/91.2; 536/23.1, 24.3, 24.5, 24.31, 24.33; 530/350

(56) References Cited

U.S. PATENT DOCUMENTS

| | | |
|---|---|---|
| 4,622,297 A | 11/1986 | Kappner et al. |
| 4,906,742 A | 3/1990 | Young et al. |
| 4,980,281 A | 12/1990 | Housey et al. |
| 5,082,767 A | 1/1992 | Hatfield et al. |
| 5,142,047 A | 8/1992 | Summerton et al. |
| 5,190,931 A | 3/1993 | Inouye |
| 5,208,149 A | 5/1993 | Inouye et al. |
| 5,266,464 A | 11/1993 | Housey et al. |
| 5,272,065 A | 12/1993 | Inouye et al. |
| 5,353,236 A | 10/1994 | Subbiah |
| 5,405,775 A | 4/1995 | Inouye et al. |
| 5,463,564 A | 10/1995 | Agrafiotis et al. |
| 5,569,588 A | 10/1996 | Ashby et al. |
| 5,574,656 A | 11/1996 | Agrafiotis et al. |
| 5,585,277 A | 12/1996 | Bowie et al. |
| 5,612,180 A | 3/1997 | Brown et al. |
| 5,639,603 A | 6/1997 | Dower et al. |
| 5,679,523 A | 10/1997 | Li et al. |
| 5,684,711 A | 11/1997 | Agrafiotis et al. |
| 5,688,655 A | 11/1997 | Housey et al. |
| 5,744,460 A | 4/1998 | Müller et al. |
| 5,756,305 A | 5/1998 | Timberlake et al. |
| 5,807,522 A | 9/1998 | Brown et al. |
| 5,821,076 A | 10/1998 | Timberlake et al. |
| 5,846,772 A | 12/1998 | Hodgson et al. |
| 5,854,020 A | 12/1998 | Hodgson et al. |
| 5,858,709 A | 1/1999 | Hodgson et al. |
| 5,869,290 A | 2/1999 | Freeman et al. |
| 5,869,604 A | 2/1999 | Rousseau et al. |
| 5,877,007 A | 3/1999 | Housey et al. |
| 5,882,643 A | 3/1999 | Lonetto |
| 5,885,572 A | 3/1999 | Gentry et al. |
| 5,891,667 A | 4/1999 | Hodgson et al. |
| 5,910,414 A | 6/1999 | Gwynn et al. |
| 5,955,275 A | 9/1999 | Kamb |
| 5,965,352 A | 10/1999 | Stoughton et al. |
| 5,972,708 A | 10/1999 | Sherratt et al. |
| 6,015,669 A | 1/2000 | Holden |
| 6,020,121 A | 2/2000 | Bao et al. |
| 6,037,123 A | 3/2000 | Benton et al. |
| 6,077,682 A | 6/2000 | Inouye et al. |
| 6,139,817 A | 10/2000 | Palmer et al. |
| 6,156,526 A | 12/2000 | Boriack-Sjodin et al. |
| 6,174,678 B1 | 1/2001 | Menzel et al. |
| 6,228,579 B1 | 5/2001 | Zyskind et al. |
| 6,228,588 B1 | 5/2001 | Benton et al. |
| 6,248,525 B1 | 6/2001 | Nilsen |
| 6,277,564 B1 | 8/2001 | Berlin et al. |
| 6,303,115 B1 | 10/2001 | Natsoulis |
| 6,348,582 B1 | 2/2002 | Black et al. |

FOREIGN PATENT DOCUMENTS

| | | |
|---|---|---|
| EP | 0 786 519 A3 | 7/1997 |
| EP | 0 786 519 A2 | 7/1997 |
| EP | 0816511 A1 | 1/1998 |
| EP | 0837142 A1 | 4/1998 |
| EP | 0889123 A2 | 1/1999 |
| EP | 0889129 A2 | 1/1999 |
| EP | 0891984 A2 | 1/1999 |
| EP | 0892056 A2 | 1/1999 |
| EP | 0892064 A2 | 1/1999 |
| EP | 0894806 A1 | 2/1999 |
| EP | 0897008 A2 | 2/1999 |
| EP | 0900845 A2 | 3/1999 |

(List continued on next page.)

OTHER PUBLICATIONS

Good, et al. 1998. Inhibition of translation and bacterial growth by peptide nucleic acid targeted to ribosomal RNA. *Proc. Natl. Acad. Sci. USA*, 95:2073–2076.

Appelt, K. 1993. Crystal structures of HIV–1 protease–inhibitor complexes. *Perspectives in Drug Discovery and Design*, 1:23–48.

(List continued on next page.)

*Primary Examiner*—W. Gary Jones
*Assistant Examiner*—Janell E. Taylor
(74) *Attorney, Agent, or Firm*—Knobbe, Martens, Olson & Bear LLP

(57) ABSTRACT

The sequences of nucleic acids encoding proteins required for *E. Coli* proliferation are disclosed. The nucleic acids can be used to express proteins or portions thereof, to obtain antibodies capable of specifically binding to the expressed proteins, and to use those expressed proteins as a screen to isolate candidate molecules for rational drug discovery programs. The nucleic acids can also be used to screen for homologous genes that are required for proliferation in microorganisms other than *E. Coli*. The nucleic acids can also be used to design expression vectors and secretion vectors. The nucleic acids of the present invention can also be used in various assay systems to screen for proliferation required genes in other organisms as well as to screen for antimicrobial agents.

12 Claims, 3 Drawing Sheets

FOREIGN PATENT DOCUMENTS

| EP | 0905247 A2 | 3/1999 |
|---|---|---|
| EP | 0906959 A2 | 4/1999 |
| WO | WO 95/02823 | 1/1995 |
| WO | WO 95/06132 | 3/1995 |
| WO | WO 96/17951 | 6/1996 |
| WO | WO 96/23075 | 8/1996 |
| WO | WO 96/40979 | 12/1996 |
| WO | WO 97/11690 | 4/1997 |
| WO | WO 97/16177 | 5/1997 |
| WO | WO 97/23642 | 7/1997 |
| WO | WO 97/27212 | 7/1997 |
| WO | WO 97/27213 | 7/1997 |
| WO | WO 97/37026 | 10/1997 |
| WO | WO 97/40851 | 11/1997 |
| WO | WO 97/42210 | 11/1997 |
| WO | WO 97/48822 | 12/1997 |
| WO | WO 98/03533 | 1/1998 |
| WO | WO 98/19162 | 5/1998 |
| WO | WO 98/20161 | 5/1998 |
| WO | WO 98/21366 | 5/1998 |
| WO | WO 98/42854 | 10/1998 |
| WO | WO 98/44135 | 10/1998 |
| WO | WO 98/50555 | 11/1998 |
| WO | WO 99/02673 | 1/1999 |
| WO | WO 99/06839 | 2/1999 |
| WO | WO 99/13893 | 3/1999 |
| WO | WO 99/23244 | 5/1999 |
| WO | WO 98/28508 | 6/1999 |
| WO | WO 99/26651 | 6/1999 |
| WO | WO 99/27074 | 6/1999 |
| WO | WO 99/27128 | 6/1999 |
| WO | WO 99/29837 | 6/1999 |
| WO | WO 99/33871 | 7/1999 |
| WO | WO 99/35494 | 7/1999 |
| WO | WO 99/36554 | 7/1999 |
| WO | WO 99/43338 | 9/1999 |
| WO | WO 99/49888 | 10/1999 |
| WO | WO 99/50462 | 10/1999 |
| WO | WO 99/52926 | 10/1999 |
| WO | WO 99/53079 | 10/1999 |
| WO | WO 99/54728 | 10/1999 |
| WO | WO 99/55729 | 11/1999 |
| WO | WO 99/61452 | 12/1999 |
| WO | WO 00/34481 | 6/2000 |
| WO | WO 00/61793 | 10/2000 |
| WO | WO 01/09164 A2 | 2/2001 |
| WO | WO 01/11081 A2 | 2/2001 |
| WO | WO 01/34809 A2 | 5/2001 |
| WO | WO 01/48209 A2 | 7/2001 |
| WO | WO 01/49721 A2 | 7/2001 |
| WO | WO 01/49775 A2 | 7/2001 |

OTHER PUBLICATIONS

Bagby, et al. 1994. Unusual helix–containing Greek keys in development–specific $Ca^{2+}$–binding protein S. $^{1}H$, $^{15}N$, and $^{13}C$ assignments and secondary structure determined with the use of multidimensional double and triple resonance heteronuclear NMR spectroscopy. *Biochemistry*, 33:2409–2421.

Bagby, et al. 1995. Solution structure of the C–terminal core domain of human TFIIB: Similarity to Cyclin A and interaction with TATA–binding protein. *Cell*, 82:857–867.

Balbes, et al. 1994. "A perspective of modern methods in computer–aided drug design." In Lipkowitz, et al., Eds. Reviews in Computational Chemistry V. Chap. 7, pp. 337–379. New York, VCH Publishers.

Brenner, et al. 2000. Salmonella nomenclature. *Journal of Clinical Microbiology*, 38(7):2465–2467.

Brunschwig, et al. 1992. A two–component T7 system for the overexpression of genes in *Pseudomonas aeruginosa*. *Gene*, 111:35–41.

Bugg, et al. 1993. Drugs by design: Structure–based design, an innovative approach to developing drugs, has recently spawned many promising therapeutic agents, including several now inhuman trials for treating AIDS, cancer and other diseases. *Scientific American*, Dec.:92–98.

Clore, et al. 1987. Three–dimensional structure of potato carboxypeptidase inhibitor in solution: A study using nuclear magnetic resonance, distance geometry, and restrained molecular dynamics. *Biochemistry*, 26:8012–8023.

Crosa, et al. 1973. Molecular relationships among the Salmonelleae. *J. Bacteriol*, 115(1):307–315.

Cwirla, et al. 1990. Peptides on phage: A vast library of peptides for identifying ligands. *Proc. Natl. Acad. Sci. USA*, 87:6378–6382.

Devlin, et al. 1990. Random peptide libraries: A source of specific protein binding molecules. *Science*, 249:404–406.

Edwards, B. H. 1999. Salmonella and Shigella species. *Clinics Lab. Med.*, 19(3):469–487.

Erickson, J. W. 1993. Design and structure of symmetry–based inhibitors of HIV–1 protease. *Perspectives in Drug Discovery and Design*, 1.109–128.

Good, et al. 1988. Antisense inhibition of gene expression in bacteria by PNA targeted to mRNA. *Nature Biotechnology*, 16:355–358.

Huycke, et al., 1998. Multiple–drug resistant enterococci: The nature of the problem and an agenda for the future. *Emerging Infectious Diseases*. 4(2):239–249.

Israelsen, et al. 1995. Cloning and partial characterization of regulated promoters from *Lactococcus lactis* Tn917–lacZ integrants with the new promoter probe vector, pAK80. *Applied and Environmental Microbiology*, 61(7):2540–2547.

Kreiswirth, et al. 1983. The toxic shock syndrome exotoxin structural gene is not detectably transmitted by a prophage. *Nature*, 305:709–712.

Lam, et al. 1994. Rational design of potent, bioavailable, nonpeptide cyclic ureas as HIV protease inhibitors. *Science*, 263:380–384.

Leboeuf, et al. 2000. Characterization of the ccpA gene of *Enterococcus faecalis*: Identification of starvation–inducible proteins regulated by CcpA. *J. Bacteriology*, 182(20):5799–5806.

Marrone, et al. 2000. Discovering high–affinity ligands from the computationally predicted structures and affinities of small molecules bound to a target: A virtual screening approach. *Perspectives in Drug Discovery and Design*, 20:209–230.

Mestres, et al. 2000. Similarity versus docking in 3D virtual screening. *Perspectives in Drug Discovery and Design*, 20:191–207.

Mojumdar, et al. 1988. Characterization of the tetracycline resistance gene of plasmid pT181 of *Staphylococcus aureus*. *J. Bacteriology*, 170(12):5522–5528.

Morrissey, et al. 2000. Molecular Cloning and Analysis of a Putative Sidercphore ABC Transporter from *Staphylococcus aureus*. *Infection and Immunity*. 68(11):6281–6288.

Moszer, et al. 1995. SubtilList: A relational database for the *Bacillus subtilis* genome. *Microbiology*, 141:261–268.

Moszer, I. 1998. The complete genome of *Bacillus subtillis*: From sequence annotation to data management and analysis. *FEBS Letters*, 430:28–36.

Nallapareddy, et al. 2000. *Enterococcus faecalis* adhesin, ace, mediates attachment to extracellular matrix proteins collagen type IV and laminin as well as collagen type I. *Infect. Immun.*, 68(9):5218–5224.

Neidhardt, F. C. (Ed.). 1996. *Escherichia coli* and Salmonella: Cellular and molecular biology, 2nd Ed., vol. 2, pp. 2269–2271. Washington D.C.: ASM Press.

Schnappinger, et al. 1995. Extracellular expression of native human anti–lysozyme fragments in *Staphylococcus carnosus*. *FEMS Microbiol. Let.*, 129:121–127.

Scott, et al. 1990. Searching for peptide ligands with an epitope library. *Science*, 249:386–390.

Shuker, et al. 1996. Discovering high–affinity ligands for proteins: SAR by NMR. *Science*, 274:1531–1534.

Suh, et al. 1995. Genetic and transcriptional organization of the *Bacillus subtilis* spc–alpha region. Database accession No. L47971 (ID: BSRPLP), XP002190118.

Suh, et al. 1996. Genetic and transcriptional organization of the *Bacillus subtillis* spc–alpha region. *Gene*, 169:17–23.

Tatusov, et al. 2000. The COG database: A tool for genome–scale analysis of protein functions and evolution. *Nucleic Acids Research*, 28(1):33–36.

Van Delden, et al. 1998. Cell–to–cell signaling and *Pseudomonas aeruginosa* infections. *Emerging Infectious Diseases*, 4(4):551–560.

Wagner, et al. 1987. Protein structures in solution by nuclear magnetic resonance and distance geometry: The polypeptide fold of the basic pancreatic trypsin inhibitor determined using two different algorithms, DISGEO and DISMAN, *J. Mol. Biol.*, 196:611–639.

Wallis, et al. 2000. Molecular basis of Salmonella–induced enteritis. *Molec. Microb.*, 36(5):997–1005.

Wlodawer, et al. 1993. Structure–based inhibitors of HIV–1 protease. *Annu. Rev. Biochem.*, 62:543–585.

Wong, et al. 2000. Genetic footprinting with mariner–based transposition in *Pseudomonas aeruginosa*. *PNAS*, 97(18): 10191–10196.

Wüthrich, et al. 1983. Pseudo–structures for the 20 common amino acids for use in studies of protein conformations by measurements of intramolecular proton–proton distance constraints with nuclear magnetic resonance. *J. Mol. Biol.*, 169:949–961.

Xia, et al. 1999. Rapid method for the identification of essential genes in *Staphylococcus aureus*. *Plasmid*, 42:144–149.

Almarsson, et al. 1993. Peptide nucleic acid (PNA) conformation and polymorphism in PNA–DNA and PNA–RNA hybrids. *Proc. Natl. Acad. Sci. U.S.A.*, 90:9542–9546.

Altschul, et al. 1990. Basic local alignment search tool. *J. Mol. Biol.*, 215:403–10.

Altschul, et al. 1997. Gapped BLAST and PSI–BLAST: A new generation of protein database search programs. *Nucleic Acid Res.*, 25(17):3389–3402.

Arigoni, et al. 1998. A genome–based approach for the identification of essential bacterial genes. *Nature Biotechnology*, 16: 851–856.

Ausubel, et al. (Eds). 1997. Current Protocols in Molecular Biology, vol. 1, Unit 1.8.1–1.8.10. John Wiley & Sons, Inc.

Basu, et al. 1997. Synthesis and characterization of a peptide nucleic acid conjugated to a D–peptide analog of insulin–like growth factor 1 for increased cellular uptake. *Bioconjugate Chem.*, 8:481–488.

Bentin, et al. 1996. Enhanced peptide nucleic acid binding to supercoiled DNA: Possible implications for DNA "breathing" dynamics. *Biochemistry*, 35:8863–8869.

Cao, et al. 1993. Expression and functional analysis of steroid receptor fragments secreted from *Staphylococcus aureus*. *J. Steroid Biochem Molec. Biol.*, 44(1):1–11.

Cotrim, et al. 1990. Isolation of genes mediating resistance to inhibitors of nucleoside and ergosterol metabolism in Leishmania by overexpression/selection. *Journal of Biological Chemistry*, 274(53):37723–37730.

Demidov, et al. 1995. Kinetics and mechanism of polyamide ("peptide") nucleic acid binding to duplex DNA. *Proc. Natl. Acad. Sci. U.S.A.*, 92:2637–2641.

Demidov, et al. 1993. Sequence selective double strand DNA cleavage by Peptide Nucleic Acid (PNA) targeting using nuclease S1. *Nucl. Acids. Res.*, 21(9):2103–2107.

Demidov, et al. 1994. Stability of peptide nucleic acids in human serum and cellular extracts. *Biochem. Pharm.*, 48(6):1010–1313.

Egholm, et al. 1995. Efficient pH–independent sequence–specific DNA binding by pseudoisocytosine–containing bis–PNA. *Nucleic Acids Res.*, 23(2):217–222.

Egholm, et al. 1993. PNA hybridizes to complementary oligonucleotides obeying the Watson–Crick hydrogen–bonding rules. *Nature*, 365:566–568.

Egholm, et al. 1992. Recognition of Guanine and Adenine in DNA by Cytosine and Thymine Containing Peptide Nucleic Acids (PNA). *J. Am. Chem. Soc.*, 114(24):9677–9678.

Engvall, E. 1980. Enzyme Immunoassay ELISA and EMIT. *Meth. Enzymol.*, 70:419–439.

Etzold, et al. 1993. Sequence Retrieval System (SRS). SRS—An indexing and retrieval tool for flat file data libraries. *Comput. Appl. Biosci.* 9(1):49–57.

Gallop, et al. 1994. Applications of Combinatorial Technologies to Drug Discovery. 1. Background and Peptide Combinatorial Libraries. *Journal of Medicinal Chemistry*, 37(9):1233–1251.

Griffin, et al. 1989. Recognition of Thymine Adenine Base Pairs by Guanine in a Pyrimidine Triple Helix Motif. *Science*, 245:967–971.

Griffith, et al. Single and bis peptide nucleic acids as triplexing agents: Binding and Stoichiometry. 1995. *J. Am. Chem. Soc.*, 117:831–832.

Hamilton, et al. 1989. New method for generating deletions and gene replacements in *Escherichia coli*. *J. Bacteriol.*, 171(9):4617–4622.

Hanvey, et al. 1992. Antisense and antigene properties of peptide nucleic acids. *Science*, 258:1481–1484.

Hensel, et al. 1995. Simultaneous identification of bacterial virulence genes by negative selection. *Science*, 269:400–403.

Hirschman, et al. 1996. Peptide nucleic acids stimulate gamma interferon and inhibit the replication of the human immunodeficiency virus. *J. Investig. Med.*, 44(6):347–351.

Ho, et al. 1989. Site–directed mutagenesis by overlap extension using the polymerase chain reaction. *Gene*, 77:51–59.

Horton, et al. 1989. Engineering hybrid genes without the use of restriction enzymes: Gene splicing by overlap extension. *Gene*, 77:61–68.

Huerta, et al. 1998. RegulonDB: A database on transcriptional regulation in *Escherichia coli*. *Nucl. Acids. Res.* 26(1):55–59.

Kohler, et al. 1975. Continuous cultures of fused cells secreting antibody of predefined specificity. *Nature*, 256:495–497.

Krause, et al. 1997. Complexes at the replication origin of *Bacillus subtilis* with homologous and heterologous dnaA protein. *J. Mol. Biol.*, 274:365–380.

Le Good, et al. 1998. Protein kinase C isotypes controlled by phosphoinositide 3–kinase through the protein kinase PDK1. *Science*, 281:2042–2045.

Link, et al. 1997. Methods for Generating Deletions and Insertions in the Genome of Wild–Type *Escherichia coli*: Application to Open Reading Frame Characterization. *J. Bacteriol.*, 179(20):6228–6237.

Margolis, et al. 2000. Peptide Deformylase in *Staphylococcus aureus*: Resistance to Inhibition is Mediated by Mutations in the Formyltransferase Gene. *Antimicrobial Agents and Chemotherapy*, 44(7):1825–1831.

Matsukura, et al. 1988. Synthesis of phosphorothioate analogues of oligodeoxyribonucleotides and their antiviral activity against human immunodeficiency virus (HIV). *Gene*, 72:343.

Mollegaard, et al. 1994. Peptide nucleic acid DNA strand displacement loops as artificial transcription promoters. *Proc. Natl. Acad. Sci. U.S.A.*, 91:3892–3895.

Nielsen, et al. 1991. Sequence–selective recognition of DNA by strand displacement with a thymine–substituted polyamide. *Science*, 254:1497–1500.

Nielsen, et al. 1993. Sequence specific inhibition of DNA restriction enzyme cleavage by PNA. *Nucl. Acids. Res.*, 21(2):197–200.

Nielsen, et al. 1994. Sequence–specific transcription arrest by peptide nucleic acid bound to the DNA template strand. *Gene*, 149:139–145.

Norton, et al. 1996. Inhibition of human telomerase activity by peptide nucleic acids. *Nature Biotechnol.*, 14:615–619.

Pardridge, et al. 1995. Vector–mediated delivery of a polyamide ("peptide") nucleic acid analogue through the blood–brain barrier in vivo. *Proc. Natl. Acad. Sci. U.S.A.*, 92:5592–5596.

Pearson, W. R. 1990. Rapid and sensitive sequence comparison with FASTP and FASTA. *Methods in Enzymology*, 183:63–98.

Plá, et al. 1990. Cloning and expression of the ponB gene, encoding penicillin–binding protein 1B of *Escherichia coli*, in heterologous systems. *J. Bacteriol.*, 172(8):4448–4455.

Rossi, et al. 1991. The potential use of catalytic RNAs in therapy of HIV infection and other diseases. *Pharmac. Ther.*, 50:245–254.

Rudd, K. E. 1998. Linkage map of *Escherichia coli* K–12, edition 10: The physical map. *Micro. & Mol. Biol. Rev.*, 62(3):985–1019.

Schena, et al. 1995. Quantitative monitoring of gene expression patterns with a complementary DNA microarray. *Science*, 270:467–470.

Shalon, et al. 1996. A DNA microarray system for analyzing complex DNA samples using two–color fluorescent probe hybridization. *Genome Research*, 6:639–645.

Tao, et al. 2000. Drug target validation: Lethal infection blocked by inducible peptide. *PNAS*, 97(2):783–786.

Uhlmann, et al. 1990. Antisense Oligonucleotides: A New Therapeutic Principle. *Chemical Reviews*, 90(4):543–584.

Vaitukaitis, et al. 1971. A method for producing specific antisera with small doses of immunogen. *J. Clin. Endocr. Metab.*, 33:988–991.

Zhang, et al. 1996. Polar Allele Duplication for Transcriptional analysis of consecutive essential genes: Application to a cluster *Escherichia coli* fatty acid biosynthetic genes. *J. Bacteriol.*, 178(12):3614–3620.

Zhang, et al. 2000. Regulated Gene Expression in *Staphylococcus aureus* for Identifying Conditional Lethal Phenotypes and Antibiotic Mode of Action. *Gene*, 255:297–305.

Armstrong, K. A. and D. P. Fan, *J. Bacteriol.*, 126:48–55, 1975, "Essential Genes in the metB–malB Region of *Escherichia coli* K12.".

Austin, A. E., et al., *Journal of Bacteriology*, 172:5312–5325, 1990, "Genetic Analysis of Lipopolysaccharide Core Biosynthesis by *Escherichia coli* k12 Insertion Mutagenesis of the RFA Locus.".

Biswas, E. E. and S. B. Biswas, *Biochem.*, 38:10919–10928, 1999, "Mechanism and DnaB Helicase of *Escherichia coli*: Structural Domains Involved in ATP Hydrolysis, DNA Binding, and Oligomerization.".

Blattner, et al., *Science*, 277:1453–1474, 1997, "The Complete Genome Sequence of *Escherichia Coli* K–12.".

den Hollander, J. G., et al., *Antimicrobia Agents & Chemotherapy*, 41:95–110, 1997, "Synergism Between Tobramycin and Ceftazidime Against a Resistant Pseudomonas Aeruginosa Strain, Tested in an In Vitro Pharmacokinetic Model.".

Fukuoka, T., et al., *Japan. J. Antibio.*, 50:411–419, 1997, "Combination Effect Between Panipenem and Vancomycin on Highly Methicillin–Resistant *Staphylococcus aureus*.".

Gabryelewicz, A., et al., *J. Physiol. Pharmacol.*, 48 Suppl., 4:93–105, 1997, "Multicenter Evaluation of Dual–Therapy (Omeprazol and Amoxycillin) for *Helicobacter Pylori*–Associated Duodenal and Gastric Ulcer (Two Years of the Observation).".

Gudkov, A. V. and I. B. Roninson, *Methods in Molec. Biol.*, vol. 69, in I. G. Cowell and C. A. Austin (Eds.), cDNA Library Protocols, Humana Press: Totowa, NY, "Isolation of Genetic Suppressor Elements (GSEs) from Random Fragment cDNA Libraries in Retroviral Vectors.".

Gutmann, L., et al., *Antimicrobial Agents & Chemotherapy*, 30:906–912, 1986, "Involvement of Penicillin–Binding Protein 2 with other Penicillin–Binding Proteins in Lysis of *Escherichia coli* by some Beta–Lactam Antibiotics Alone and in Synergistic Lytic Effect of Amdinocillin (Mecillinam).".

Hiasa, H. and K. J. Marians, *J. Biol. Chem.*, 274:27244–27248, 1999, "Initiation of Bidirectional Replication at the Chromosomal Origin is Directed by the Interaction Between Helicase and Primase.".

Holzmayer, T. A., et al., *Nucleic Acids Res.*, 20(4):711–717, 1992, "Isolation of Dominant Negative Mutants and Inhibitory Antisense RNA Sequences by Expression Selection of Random DNA Fragments.".

Ji, Y., et al., *Journal of Bacteriology*, 181(21):6585–6590, 1999, "Regulated Antisense RNA Eliminates Alpha–Toxin Virulence in *Staphylococcus aureus* Infection.".

Lee, N. G., et al., *Infection and Immunity.*, 63(3):818–824, 1995, "Molecular Cloning and Characterization of the Nontypable Haemophilus Influenzae–2019 rfaE Gene Required for Lipopolysaccharide Biosynthesis.".

Post et al., Proceedings of the National Academy of Sciences of the USA, New York, 76(4):1697–1701, 1979, "Nucleotide Sequence of the Ribosomal Protein Gene Cluster Adjacent to the Gene for RNA Polymerase Subunit Beta in *Escherichia coli*.".

San Martin, C., et al., *Structure*, 6:501–509, 1998, "Three–Dimensional Reconstructions from Cryoelectron Microscopy Images Reveal an Intimate Complex Between Helicase DnaB and its Loading Partner DnaC.".

Smith, C. E., et al., *Diagnos. Microbiol. Infect. Disease*, 27:85–92, 1997, "Assessment of the Synergistic Interactions of Levofloxacin and Ampicillin against Enterococcus Faecium by the Checkerboard Agar Dilution and Time–Kill Methods.".

Sutton, M. D., et al., *J. Biol. Chem.*, 273:34255–34262, 1998, "*Escherichia coli* DnaA Protein. The N–Terminal Domain and Loading of DnaB Helicase at the *E. coli* Chromosomal.".

Valvano, M. A., et al., *Journal of Bacteriology*, 182:488–497, 2000, "The rfaE Gene from *Escherichia coli* Encodes a Bifunctional Protein Involved in Biosynthesis of the Lipopolysaccharide Core Precursor ADP–L–glycero–D–manno–heptose.".

Van Heeswijk, W. C., et al., *Molecular Microbiology*, 9:443–457, 1993, "The Genes of the Glutamine Synthetase Adenylylation Cascade are not Regulated by Nitrogen in *Escherichia coli*.".

Wechsler, J. A. and J. D. Gross, *Mol. Gen. Genetics*, 113:273–284, 1971, "*Escherichia coli* Mutants Temperature–Sensitive for DNA Synthesis.".

Akerley, et al., "A genome–scale analysis for identification of genes required for growth or survival of *Haemophilus influenzae*," *PNAS*, 99(2):966–971 (2002).

Blattner, et al., "*Escherichia coli* K12 MG1655 section 101 of 400 of the complete genome," Database accession No. AE000211, XP002181472.

Blattner, et al., "*Escherichia coli* K12 MG1655 section 298 of 400 of the complete genome," Database accession No. AE000408, XP002181129.

Blattner, et al., "*Escherichia coli* K12 MG1655 section 305 of 400 of the complete genome," Database accession No. AE000415, XP002181474.

Blattner, et al., "*Escherichia coli* K12 MG1655 section 337 of 400 of the complete genome," Database accession No. AE000447, XP002181127.

Blattner, et al., "Hypothetical 79.5 kDa protein in MRCA–PCKA intergenic region (0711)," Database accession No. P45800, XP002181475.

Blattner, et al., "Hypothetical protein YCFS precursor," Database accession No. P75954, XP002181473.

Burland, et al., "60 kDa inner–membrane protein," Database accession No. P25714, XP002181128.

Burland, et al., "*E coli*; the region from 81.5 to 84.5 minutes," Database accession No. L10328, XP002181130.

Burland, et al., "DNA sequence and analysis of 136 kilobases of the *Escherichia coli* genome: Organizational symmetry around the origin of replication," *Genomics*, 16:551–561 (1993).

Ceretti, et al., "*Escherichia coli* spc ribosomal protein operon," Database accession No. X01563, XP002181131.

De Backer, et al., "An antisense–based functional genomics approach for identification of genes critical for growth of *Candida albicans*," *Nature Biotechnology*, 19:235–241 (2001).

Lancy, et al., "Nucleotide Sequences of dnaE, the Gene for the Polymerase Subunit of DNA Polymerase III in *Salmonella typhimurium*, and a Variant That Facilitates Growth in the Absence of Another Polymerase Subunit," *Journal of Bacteriology*, 171(10):5581–5586 (1989).

Oshima, et al., "A 718–kb DNA Sequence of the *Escherichia coli* K–12 Genome Corresponding to the 12.7–28.0 min Region on the Linkage Map," *DNA Research*, 3:137–155 (1996).

Oshima, et al., "*Escherichia coli* genomic DNA (25.2–25.6 min)," Database accession No. D90747, XP002181476 (1996).

Plunkett, et al., "*Escherichia coli* K–12 chromosomal region from 67.4 to 76.0 minutes," Database accession No. U18997, XP002181132, XP002181477.

International Search Report from co–pending application PCT/US00/30950.

GENES ESSENTIAL FOR MICROBIAL PROLIFERATION AND ANTISENSE THERETO

RELATED APPLICATIONS

This application claims priority from U.S. Provisional Patent Application Serial No. 60/164,415 filed Nov. 9, 1999, the disclosure of which is incorporated herein by reference in its entirety.

BACKGROUND OF THE INVENTION

Since the discovery of penicillin, the use of antibiotics to treat the ravages of bacterial infections has saved millions of lives. With the advent of these "miracle drugs," for a time it was popularly believed that humanity might, once and for all, be saved from the scourge of bacterial infections. In fact, during the 1980s and early 1990s, many large pharmaceutical companies cut back or eliminated antibiotics research and development. They believed that infectious disease caused by bacteria finally had been conquered and that markets for new drugs were limited. Unfortunately, this belief was overly optimistic.

The tide is beginning to turn in favor of the bacteria as reports of drug resistant bacteria become more frequent. The United States Centers for Disease Control announced that one of the most powerful known antibiotics, vancomycin, was unable to treat an infection of the common *Staphylococcus aureus* (staph). This organism is commonly found in our environment and is responsible for many nosocomial infections. The import of this announcement becomes clear when one considers that vancomycin was used for years to treat infections caused by stubborn strains of bacteria, like staph. In short, the bacteria are becoming resistant to our most powerful antibiotics. If this trend continues, it is conceivable that we will return to a time when what are presently considered minor bacterial infections are fatal diseases.

There are a number of causes for the predicament in which practitioners of medical arts find themselves. Overprescription and improper prescription habits by some physicians have caused an indiscriminate increase in the availability of antibiotics to the public. The patient is also partly responsible, for even in instances where an antibiotic is the appropriate treatment, patients will often improperly use the drug, the result being yet another population of bacteria that is resistant, in whole or in part, to traditional antibiotics.

The bacterial scourges that have haunted humanity remain, in spite of the development of modem scientific practices to deal with the diseases that they cause. Drug resistant bacteria are now advancing on the health of humanity. A new generation of antibiotics to once again deal with the pending health threat that bacteria present is required.

DISCOVERY OF NEW ANTIBIOTICS

As more and more bacterial strains become resistant to the panel of available antibiotics, new compounds are required. In the past, practitioners of pharmacology would have to rely upon traditional methods of drug discovery to generate novel, safe and efficacious compounds for the treatment of disease. Traditional drug discovery methods involve blindly testing potential drug candidate-molecules, often selected at random, in the hope that one might prove to be an effective treatment for some disease. The process is painstaking and laborious, with no guarantee of success. Today, the average cost to discover and develop a new drug is nearly US $500 million, and the average time is 15 years from laboratory to patient. Improving this process, even incrementally, would represent a huge advance in the generation of novel antimicrobial agents.

Newly emerging practices in drug discovery utilize a number of biochemical techniques to provide for directed approaches to creating new drugs, rather than discovering them at random. For example, gene sequences and proteins encoded thereby that are required for the proliferation of an organism make for excellent targets since exposure of bacteria to compounds active against these targets would result in the inactivation of the organism. Once a target is identified, biochemical analysis of that target can be used to discover or to design molecules that interact with and alter the functions of the target. Using physical and computational techniques, to analyze structural and biochemical targets in order to derive compounds that interact with a target is called rational drug design and offers great future potential. Thus, emerging drug discovery practices use molecular modeling techniques, combinatorial chemistry approaches, and other means to produce and screen and/or design large numbers of candidate compounds.

Nevertheless, while this approach to drug discovery is clearly the way of the future, problems remain. For example, the initial step of identifying molecular targets for investigation can be an extremely time consuming task. It may also be difficult to design molecules that interact with the target by using computer modeling techniques. Furthermore, in cases where the function of the target is not known or is poorly understood, it may be difficult to design assays to detect molecules that interact with and alter the functions of the target. To improve the rate of novel drug discovery and development, methods of identifying important molecular targets in pathogenic microorganisms and methods for identifying molecules that interact with and alter the functions of such molecular targets are urgently required.

*Escherichia coli* represents an excellent model system to understand bacterial biochemistry and physiology. The estimated 4288 genes scattered along the $4.6 \times 10^6$ base pairs of the *Escherichia coli* (*E. coli*) chromosome offer tremendous promise for the understanding of bacterial biochemical processes. In turn, this knowledge will assist in the development of new tools for the diagnosis and treatment of bacteria-caused human disease. The entire *E. coli* genome has been sequenced, and this body of information holds a tremendous potential for application to the discovery and development of new antibiotic compounds. Yet, in spite of this accomplishment, the general functions or roles of many of these genes are still unknown. For example, the total number of proliferation-required genes contained within the *E. coli* genome is unknown, but has been variously estimated at around 200 to 700 (Armstrong, K. A. and Fan, D. P. Essential Genes in the metB-malB Region of *Escherichia coli* K12, 1975, J. Bacteriol. 126: 48–55).

Novel, safe and effective antimicrobial compounds are needed in view of the rapid rise of antibiotic resistant microorganisms. However, prior to this invention, the characterization of even a single bacterial gene was a painstaking process, requiring years of effort. Accordingly, there is an urgent need for more novel methods to identify and characterize bacterial genomic sequences that encode gene products required for proliferation and for methods to identify molecules that interact with and alter the functions of such genes and gene products.

SUMMARY OF THE INVENTION

One embodiment of the present invention is a purified or isolated nucleic acid sequence consisting essentially of one of SEQ ID NOs: 1–127, wherein expression of said nucleic acid inhibits proliferation of a microorganism. The nucleic acid sequence may be complementary to at least a portion of a coding sequence of a gene whose expression is required for proliferation of a microorganism. The nucleic acid sequence may be complementary to at least a portion of an RNA required for proliferation of a microorganism. The RNA may be an RNA encoding more than one gene product.

Another embodiment of the present invention is a nucleic acid comprising a fragment of one of SEQ ID NOs.: 1–127, said fragment selected from the group consisting of fragments comprising at least 10, at least 20, at least 25, at least 30, at least 50 and more than 50 consecutive bases of one of SEQ ID NOs: 1–127.

Another embodiment of the present invention is a vector comprising a promoter operably linked to the nucleic acid sequences of each of the preceding paragraphs. The promoter may be active in a microorganism selected from the group consisting of *Aspergillus fumigatus, Bacillus anthracis, Campylobacter jejuni, Candida albicans, Chlamydia pneumoniae, Chlamydia trachomatus, Clostridium botulinum, Cryptococcus neoformans, Enterobacter cloacae, Enterococcus faecalis, Escherichia coli, Haemophilus influenzae, Helicobacter pylori, Klebsiella pneumoniae, Mycobacterium leprae, Mycobacterium tuberculosis, Neisseria gonorrhoeae, Pseudomonas aeruginosa, Saccharomyces cerevisae, Salmonella cholerasuis, Salmonella paratyphi, Salmonella typhi, Salmonella typhimurium, Staphylococcus aureus, Staphylococcus epidermidis, Streptococcus pneumoniae, Treponema pallidum*, and *Yersinia pestis* or any species falling within the genera of any of the above species.

Another embodiment of the present invention is a host cell containing the vectors of the preceding paragraph.

Another embodiment of the present invention is a purified or isolated nucleic acid consisting essentially of the coding sequence of one of SEQ ID NOs: 128–298.

Another embodiment of the present invention is a fragment of the nucleic acid of the preceding paragraph, said fragment comprising at least 10, at least 20, at least 25, at least 30, at least 50 or more than 50 consecutive bases of one of SEQ ID NOs: 128–298.

Another embodiment of the present invention is a vector comprising a promoter operably linked to the nucleic acid of the preceding two paragraphs.

Another embodiment of the present invention is a purified or isolated antisense nucleic acid comprising a nucleic acid sequence complementary to at least a portion of an intragenic sequence, intergenic sequence, sequences spanning at least a portion of two or more genes, 5' noncoding region, or 3' noncoding region within an operon comprising a proliferation-required gene whose activity or expression is inhibited by an antisense nucleic acid comprising one of SEQ ID NOs.: 1–127.

Another embodiment of the present invention is a purified or isolated nucleic acid comprising a nucleic acid having at least 70% identity to a sequence selected from the group consisting of SEQ ID NOs.: 1–127, fragments comprising at least 25 consecutive nucleotides of SEQ ID NOs.: 1–127, the sequences complementary to SEQ ID NOs.: 1–127 and the sequences complementary to fragments comprising at least 25 consecutive nucleotides of SEQ ID NOs.: 1–127 as determined using BLASTN version 2.0 with the default parameters. The nucleic acid may be from an organism selected from the group consisting of *Aspergillus fumigatus, Bacillus anthracis, Campylobacter jejuni, Candida albicans, Chlamydia pneumoniae, Chlamydia trachomatus, Clostridium botulinum, Cryptococcus neoformans, Enterobacter cloacae, Enterococcus faecalis, Staphylococcus aureus, Haemophilus influenzae, Helicobacter pylori, Klebsiella pneumoniae, Mycobacterium leprae, Mycobacterium tuberculosis, Neisseria gonorrhoeae, Pseudomonas aeruginosa, Saccharomyces cerevisae, Salmonella cholerasuis, Salmonella paratyphi, Salmonella typhi, Salmonella typhimurium, Staphylococcus aureus, Staphylococcus epidermidis, Streptococcus pneumoniae, Treponema pallidum*, and *Yersinia pestis* or any species falling within the genera of any of the above species.

Another embodiment of the present invention is a vector comprising a promoter operably linked to a nucleic acid encoding a polypeptide whose expression is inhibited by an antisense nucleic acid comprising one of SEQ ID NOs.: 1–127. The polypeptide may comprise a polypeptide comprising a sequence selected from the group consisting of SEQ ID NOs: 299–469.

Another embodiment of the present invention is a host cell containing the vector of the preceding paragraph.

Another embodiment of the present invention is a purified or isolated polypeptide comprising a polypeptide whose expression is inhibited by an antisense nucleic acid comprising one of SEQ ID NOs.: 1–127, or a fragment selected from the group consisting of fragments comprising at least 5, at least 10, at least 20, at least 30, at least 40, at least 50, at least 60 or more than 60 consecutive amino acids of one of the said polypeptides. The polypeptide may comprise a polypeptide comprising one of SEQ ID NOs.: 299–469 or a fragment comprising at least 5, at least 10, at least 20, at least 30, at least 40, at least 50, at least 60 or more than 60 consecutive amino acids of a polypeptide comprising a sequence selected from the group consisting of SEQ ID NOs.: 299–469.

Another embodiment of the present invention is a purified or isolated polypeptide comprising a polypeptide having at least 25% identity to a polypeptide whose expression is inhibited by a sequence selected from the group consisting of SEQ ID NOs.: 1–127, or at least 25% identity to a fragment comprising at least 5, at least 10, at least 20, at least 30, at least 40, at least 50, at least 60 or more than 60 consecutive amino acids of a polypeptide whose expression is inhibited by a nucleic acid selected from the group consisting of SEQ ID NOs.: 1–127 as determined using FASTA version 3.0t78 with the default parameters. The polypeptide may have at least 25% identity to a polypeptide comprising one of SEQ ID NOs: 299–469 or at least 25% identity to a fragment comprising at least 5, at least 10, at least 20, at least 30, at least 40, at least 50, at least 60 or more than 60 consecutive amino acids of a polypeptide comprising one of SEQ ID NOs.: 299–469 as determined using FASTA version 3.0t78 with the default parameters.

Another embodiment of the present invention is an antibody capable of specifically binding one of the polypeptides of the preceding paragraph.

Another embodiment of the present invention is a method of producing a polypeptide, comprising introducing a vector comprising a promoter operably linked to a nucleic acid encoding a polypeptide whose expression is inhibited by an antisense nucleic acid comprising one of SEQ ID NOs.: 1–127 into a cell. The method may further comprise the step of isolating said polypeptide. The polypeptide may comprise a sequence selected from the group consisting of SEQ ID NOs.: 299–469.

Another embodiment of the present invention is a method of inhibiting proliferation of a microorganism comprising inhibiting the activity or reducing the amount of a gene product whose expression is inhibited by an antisense nucleic acid comprising a sequence selected from the group consisting of SEQ ID NOs.: 1–127 or inhibiting the activity or reducing the amount of a nucleic acid encoding said gene product. The gene product may comprise a polypeptide comprising a sequence selected from the group consisting of SEQ ID NOs.: 299–469.

Another embodiment of the present invention is a method for identifying a compound which influences the activity of a gene product required for proliferation, said gene product comprising a gene product whose expression is inhibited by an antisense nucleic acid comprising a sequence selected from the group consisting of SEQ ID NOs.: 1–127, said method comprising contacting said gene product with a candidate compound and determining whether said compound influences the activity of said gene product. The gene product may be a polypeptide and said activity may be an enzymatic activity. The gene product may be a polypeptide and said activity may be a carbon compound catabolism activity. The gene product may be a polypeptide and said activity may be a biosynthetic activity. The gene product may be a polypeptide and said activity may be a transporter activity. The gene product may be a polypeptide and said activity may be a transcriptional activity. The gene product may be a polypeptide and said activity may be a DNA replication activity. The gene product may be a polypeptide and said activity my be a cell division activity. The gene product may be a polypeptide comprising a sequence selected from the group consisting of SEQ ID NOs.: 299–469.

Another embodiment of the present invention is a compound identified using the methods of the preceding paragraph.

AThe method of claim 28, wherein said gene product is a polypeptide comprising a sequence selected from the group consisting of SEQ ID NOs.: 299–469. method for identifying a compound or nucleic acid having the ability to reduce the activity or level of a gene product required for proliferation, said gene product comprising a gene product whose activity or expression is inhibited by an antisense nucleic acid comprising a sequence selected from the group consisting of SEQ ID NOs.: 1–127, said method comprising:

(a) providing a target that is a gene or RNA, wherein said target comprises a nucleic acid encoding said gene product;

(b) contacting said target with a candidate compound or nucleic acid; and (c) measuring an activity of said target.

The target may be a messenger RNA molecule and said activity may be translation of said messenger RNA. The target may be a messenger RNA molecule and said activity may be transcription of a gene encoding said messenger RNA. The target may be a gene and said activity may be transcription of said gene. The target may be a nontranslated RNA and said activity may be processing or folding of said nontranslated RNA or assembly of said nontranslated RNA into a protein/RNA complex. The target gene or RNA may encode a polypeptide comprising a sequence selected from the group consisting of SEQ ID NOs.: 299–469.

Another embodiment of the present invention is a compound or nucleic acid identified using the methods of the preceding paragraph.

Another embodiment of the present invention is a method for identifying a compound which reduces the activity or level of a gene product required for proliferation of a microorganism, wherein the activity or expression of said gene product is inhibited by an antisense nucleic acid comprising a sequence selected from the group consisting of SEQ ID NOs.: 1–127, said method comprising the steps of:

(a) expressing a sublethal level of an antisense nucleic acid complementary to a nucleic acid encoding said gene product in a cell to reduce the activity or amount of said gene product in said cell, thereby producing a sensitized cell;

(b) contacting said sensitized cell with a compound; and (c) determining whether said compound inhibits the growth of said sensitized cell.

The determining step may comprise determining whether said compound inhibits the growth of said sensitized cell to a greater extent than said compound inhibits the growth of a nonsensitized cell. The cell may be selected from the group consisting of bacterial cells, fungal cells, plant cells, and animal cells. The cell may be a Gram negative bacterium. The cell may be an *E. coli* cell. The cell may be from an organism selected from the group consisting of *Aspergillus fumigatus, Bacillus anthracis, Campylobacter jejuni, Candida albicans, Chlamydia pneumoniae, Chlamydia trachomatus, Clostridium botulinum, Cryptococcus neoformans, Enterobacter cloacae, Enterococcus faecalis, Haemophilus influenzae, Helicobacter pylori, Klebsiella pneumoniae, Mycobacterium leprae, Mycobacterium tuberculosis, Neisseria gonorrhoeae, Pseudomonas aeruginosa, Saccharomyces cerevisae, Salmonella cholerasuis, Salmonella paratyphi, Salmonella typhi, Salmonella typhimurium, Staphylococcus aureus, Staphylococcus epidermidis, Streptococcus pneumoniae, Treponema pallidum*, and *Yersinia pestis* or any species falling within the genera of any of the above species. The antisense nucleic acid may be transcribed from an inducible promoter. The method may further comprise the step of contacting said cell with a concentration of inducer which induces said antisense nucleic acid to a sublethal level. Growth inhibition may be measured by monitoring optical density of a culture growth solution. The gene product may be a polypeptide. The polypeptide may comprise a sequence selected from the group consisting of SEQ ID NOs.: 299–469. The gene product may be an RNA.

Another embodiment of the present invention is a compound identified using the methods of the preceding paragraph.

Another embodiment of the present invention is a method for inhibiting cellular proliferation comprising introducing a compound with activity against a gene whose activity or expression is inhibited by an antisense nucleic acid comprising a sequence selected from the group consisting of SEQ ID NOs.: 1–127 or a compound with activity against the product of said gene into a population of cells expressing said gene. The compound may be an antisense nucleic acid comprising a sequence selected from the group consisting of SEQ ID NOs.: 1–127, or a proliferation-inhibiting portion thereof. The proliferation inhibiting portion of one of SEQ ID NOs.: 1–127 may be a fragment comprising at least 10, at least 20, at least 25, at least 30, at least 50 or more than 51 consecutive bases of one of SEQ ID NOs.: 1–127. The population may be a population selected from the group consisting of bacterial cells, fungal cells, plant cells, and animal cells. The population may be a population of Gram negative bacteria. The population may be a population of *E. coli* cells. The population may be a population selected from the group consisting of *Aspergillus fumigatus, Bacillus anthracis, Campylobacter jejuni, Candida albicans, Chlamydia pneumoniae, Chlamydia trachomatus,*

*Clostridium botulinum, Cryptococcus neoformans, Enterobacter cloacae, Enterococcus faecalis, Haemophilus influenzae, Helicobacter pylori, Klebsiella pneumoniae, Mycobacterium leprae, Mycobacterium tuberculosis, Neisseria gonorrhoeae, Pseudomonas aeruginosa, Saccharomyces cerevisae, Salmonella cholerasuis, Salmonella paratyphi, Salmonella typhi, Salmonella typhimurium, Staphylococcus aureus, Staphylococcus epidermidis, Streptococcus pneumoniae, Treponema pallidum*, and *Yersinia pestis* cells or cells from any species falling within the genera of any of the above species. The gene may encode a polypeptide comprising a sequence selected from the group consisting of SEQ ID NOs.: 299–469.

Another embodiment of the present invention is a preparation comprising an effective concentration of an antisense nucleic acid comprising a sequence selected from the group consisting of SEQ ID NOs.: 1–127, or a proliferation-inhibiting portion thereof in a pharmaceutically acceptable carrier. The proliferation-inhibiting portion of one of SEQ ID NOs.: 1–127 may comprise at least 10, at least 20, at least 25, at least 30, at least 50 or more than 50 consecutive bases of one of SEQ ID NOs.: 1–127.

Another embodiment of the present invention is a method for inhibiting the activity or expression of a gene in an operon required for proliferation wherein the activity or expression of at least one gene in said operon is inhibited by an antisense nucleic acid comprising a sequence selected from the group consisting of SEQ ID NOs.: 1–127, said method comprising contacting a cell in a cell population with an antisense nucleic acid comprising at least a proliferation-inhibiting portion of said operon. The antisense nucleic acid comprises a sequence selected from the group consisting of SEQ ID NOs.: 1–127 or a proliferation inhibiting portion thereof. The method of claim 68, wherein said cell is contacted with said antisense nucleic acid by introducing a plasmid which expresses said antisense nucleic acid into said cell population. The cell may be contacted with said antisense nucleic acid by introducing a phage which expresses said antisense nucleic acid into said cell population. The cell may be contacted with said antisense nucleic acid by expressing said antisense nucleic acid from the chromosome of cells in said cell population. The cell may be contacted with said antisense nucleic acid by introducing a promoter adjacent to a chromosomal copy of said antisense nucleic acid such that said promoter directs the synthesis of said antisense nucleic acid. The cell may be contacted with said antisense nucleic acid by introducing a retron which expresses said antisense nucleic acid into said cell population. The cell may be contacted with said antisense nucleic acid by introducing a ribozyme into said cell-population, wherein a binding portion of said ribozyme is complementary to said antisense oligonucleotide. The cell may be contacted with said antisense nucleic acid by introducing a liposome comprising said antisense oligonucleotide into said cell. The cell may be contacted with said antisense nucleic acid by electroporation of said antisense nucleic acid. The antisense nucleic acid may be a fragment comprising at least 10, at least 20, at least 25, at least 30, at least 50 or more than 50 consecutive bases of one of SEQ ID NOs.: 1–127. The antisense nucleic acid may be an oligonucleotide.

Another embodiment of the present invention is a method for identifying a gene which is required for proliferation of a microorganism comprising:

(a) contacting a microorganism other than *E. coli* with a nucleic acid selected from the group consisting of SEQ ID NOs.: 1–127;

(b) determining whether said nucleic acid inhibits proliferation of said microorganism; and (c) identifying the gene in said microorganism which is inhibited by said nucleic acid.

The microorganism may be a Gram negative bacterium. The microorganism may be selected from the group consisting of *Aspergillus fumigatus, Bacillus anthracis, Campylobacter jejuni, Candida albicans, Chlamydia pneumoniae, Chlamydia trachomatus, Clostridium botulinum, Cryptococcus neoformans, Enterobacter cloacae, Enterococcus faecalis, Haemophilus influenzae, Helicobacter pylori, Klebsiella pneumoniae, Mycobacterium leprae, Mycobacterium tuberculosis, Neisseria gonorrhoeae, Pseudomonas aeruginosa, Saccharomyces cerevisae, Salmonella cholerasuis, Salmonella paratyphi, Salmonella typhi, Salmonella typhimurium, Staphylococcus aureus, Staphylococcus epidermidis, Streptococcus pneumoniae, Treponema pallidum*, and *Yersinia pestis* or any species falling within the genera of any of the above species. The method may further comprise introducing said nucleic acid into a vector functional in said microorganism prior to introducing said inhibitory nucleic acid into said microorganism.

Another embodiment of the present invention is a method for identifying a compound having the ability to inhibit proliferation of a microorganism comprising:

(a) identifying in a first microorganism a homolog of a gene or gene product present in a second microorganism which is different than said first microorganism, wherein the activity or level of said gene or gene product is inhibited by a nucleic acid comprising a sequence selected from the group consisting of SEQ ID NOs. 1–127;

(b) identifying an inhibitory nucleic acid sequence which inhibits the activity of said homolog in said first microorganism;

(c) contacting said first microorganism with a sublethal level of said inhibitory nucleic acid, thus sensitizing said first microorganism;

(d) contacting the sensitized microorganism of step (c) with a compound; and (e) determining whether said compound inhibits proliferation of said sensitized microorganism.

The determining step may comprise determining whether said compound inhibits proliferation of said sensitized microorganism to a greater extent than said compound inhibits proliferation of a nonsensitized microorganism. Step (a) may comprise identifying a homologous nucleic acid to a gene or gene product whose activity or level is inhibited by a nucleic acid selected from the group consisting of SEQ ID NOs. 1–127 or a nucleic acid encoding a homologous polypeptide to a polypeptide whose activity or level is inhibited by a nucleic acid selected from the group consisting of SEQ ID NOs. 1–127 by using an algorithm selected from the group consisting of BLASTN version 2.0 with the default parameters and FASTA version 3.0t78 algorithm with the default parameters to identify said homologous nucleic acid or said nucleic acid encoding a homologous polypeptide in a database. Step (a) may comprise identifying a homologous nucleic acid or a nucleic acid encoding a homologous polypeptide by identifying nucleic acids which hybridize to said first gene. Step (a) may comprise expressing a nucleic acid selected from the group consisting of SEQ ID NOs. 1–127 in said microorganism. The inhibitory nucleic acid may be an antisense nucleic acid. The inhibitory nucleic acid may comprise an antisense nucleic acid to a portion of said homolog. The inhibitory nucleic acid may comprise an antisense nucleic acid to a portion of the operon encoding said homolog. The step of contacting the first microorganism with a sublethal level of said inhibitory nucleic acid may comprise directly contacting said microorganism with said inhibitory nucleic acid. The step of contacting the first microorganism with a sublethal level of said inhibitory nucleic acid may comprise expressing an antisense nucleic acid to said homolog in said microorganism. The gene product may comprise a polypeptide comprising a sequence selected from the group consisting of SEQ ID NOs.: 299–469.

Another embodiment of the present invention is a compound identified using the method of the preceding paragraph.

Another embodiment of the present invention is a method of identifying a compound having the ability to inhibit proliferation comprising:

(a) contacting a microorganism other than *E. coli* with a sublethal level of a nucleic acid comprising a sequence selected from the group consisting of SEQ ID NOs. 1–127 or a portion thereof which inhibits the proliferation of *E. coli*, thus sensitizing said microorganism;

(b) contacting the sensitized microorganism of step (a) with a compound; and (c) determining whether said compound inhibits proliferation of said sensitized microorganism.

The determining step may comprise determining whether said compound inhibits proliferation of said sensitized microorganism to a greater extent than said compound inhibits proliferation of a nonsensitized microorganism.

Another embodiment of the present invention is a compound identified using the methods of the preceding paragraph.

Another embodiment of the present invention is a method for identifying a compound having activity against a biological pathway required for proliferation comprising:

(a) sensitizing a cell by expressing a sublethal level of an antisense nucleic acid complementary to a nucleic acid encoding a gene product required for proliferation, wherein the activity or expression of said gene product is inhibited by an antisense nucleic acid comprising a sequence selected from the group consisting of SEQ ID NOs.: 1–27, in said cell to reduce the activity or amount of said gene product;

(b) contacting the sensitized cell with a compound; and (c) determining whether said compound inhibits the growth of said sensitized cell.

The determining step may comprise determining whether said compound inhibits the growth of said sensitized cell to a greater extent than said compound inhibits the growth of a nonsensitized cell. The cell may be selected from the group consisting of bacterial cells, fungal cells, plant cells, and animal cells. The cell may be a Gram negative bacterium. The Gram negative bacterium may be *E. coli*. The cell may be selected from the group consisting of *Aspergillus fumigatus, Bacillus anthracis, Campylobacter jejuni, Candida albicans, Chlamydia pneumoniae, Chlamydia trachomatus, Clostridium botulinum, Cryptococcus neoformans, Enterobacter cloacae, Enterococcus faecalis, Haemophilus influenzae, Helicobacter pylori, Klebsiella pneumoniae, Mycobacterium leprae, Mycobacterium tuberculosis, Neisseria gonorrhoeae, Pseudomonas aeruginosa, Saccharomyces cerevisae, Salmonella cholerasuis, Salmonella paratyphi, Salmonella typhi, Salmonella typhimurium, Staphylococcus aureus, Staphylococcus epidermidis, Streptococcus pneumoniae, Treponema pallidum,* and *Yersinia pestis* or any species falling within the genera of any of the above species. The antisense nucleic acid may be transcribed from an inducible promoter. The method may further comprise contacting the cell with an agent which induces expression of said antisense nucleic acid from said inducible promoter, wherein said antisense nucleic acid is expressed at a sublethal level. The inhibition of proliferation may be measured by monitoring the optical density of a liquid culture. The gene product may comprise a polypeptide comprising a sequence selected from the group consisting of SEQ ID NOs.: 299–469.

Another embodiment of the present invention is a compound identified using the methods of the preceding paragraph.

Another embodiment of the present invention is a method for identifying a compound having the ability to inhibit cellular proliferation comprising:

(a) contacting a cell with an agent which reduces the activity or level of a gene product required for proliferation of said cell, wherein said gene product is a gene product whose activity or expression is inhibited by an antisense nucleic acid comprising a sequence selected from the group consisting of SEQ ID NOs.: 1–127;

(b) contacting said cell with a compound; and (c) determining whether said compound reduces proliferation of said contacted cell.

The determining step may comprise determining whether said compound reduces proliferation of said contacted cell to a greater extent than said compound reduces proliferation of cells which have not been contacted with said agent. The agent which reduces the activity or level of a gene product required for proliferation of said cell may comprise an antisense nucleic acid to a gene or operon required for proliferation. The agent which reduces the activity or level of a gene product required for proliferation of said cell may comprise a compound known to inhibit growth or proliferation of a microorganism. The cell may contain a mutation which reduces the activity or level of said gene product required for proliferation of said cell. The mutation may be a temperature sensitive mutation. The gene product may comprise a polypeptide comprising a sequence selected from the group consisting of SEQ ID NOs.: 299–469.

Another embodiment of the present invention is a compound identified using the method of the preceding paragraph.

Another embodiment of the present invention is a method for identifying the biological pathway in which a proliferation-required gene or its gene product lies, wherein said gene or gene product comprises a gene or gene product whose activity or expression is inhibited by an antisense nucleic acid comprising a sequence selected from the group consisting of SEQ ID NOs.: 1–127, said method comprising:

(a) expressing a sublethal level of an antisense nucleic acid which inhibits the activity of said proliferation-required gene or gene product in a cell;

(b) contacting said cell with a compound known to inhibit growth or proliferation of a microorganism, wherein the biological pathway on which said compound acts is known; and (c) determining whether said cell is sensitive to said compound.

The determining step may comprise determining whether said cell has a substantially greater sensitivity to said compound than a cell which does not express said sublethal level of said antisense nucleic acid and wherein said gene or gene product lies in the same pathway on which said compound acts if said cell expressing said sublethal level of said antisense nucleic acid has a substantially greater sensitivity to said compound than said cell which does not express said sublethal level of said antisense nucleic acid. The gene product may comprise a polypeptide comprising a sequence selected from the group consisting of SEQ ID NOs.: 299–469.

Another embodiment of the present invention is a method for determining the biological pathway on which a test compound acts comprising:

(a) expressing a sublethal level of an antisense nucleic acid complementary to a proliferation-required nucleic acid in a cell, wherein the activity or expression of said proliferation-required nucleic acid is inhibited by an antisense nucleic acid comprising a sequence selected from the group consisting of SEQ ID NOs.: 1–127 and wherein the biological pathway in which said proliferation-required nucleic acid or a protein encoded by said proliferation-required polypeptide lies is known, (b) contacting said cell with said test compound; and (c) determining whether said cell is sensitive to said test compound.

The determining step may comprise determining whether said cell has a substantially greater sensitivity to said test compound than a cell which does not express said sublethal level of said antisense nucleic acid. The method may further comprise:

(d) expressing a sublethal level of a second antisense nucleic acid complementary to a second proliferation-required nucleic acid in a second cell, wherein said second proliferation-required nucleic acid is in a different biological pathway than said proliferation-required nucleic acid in step (a); and (e) determining whether said second cell does not have a substantially greater sensitivity to said test compound than a cell which does not express said sublethal level of said second antisense nucleic acid, wherein said test compound is specific for the biological pathway against which the antisense nucleic acid of step (a) acts if said second cell does not have substantially greater sensitivity to said test compound.

Another embodiment of the present invention is a purified or isolated nucleic acid comprising a sequence selected from the group consisting of SEQ ID NOs.: 1–127.

Another embodiment of the present invention is a compound which interacts with a gene or gene product whose activity or expression is inhibited by an antisense nucleic acid comprising one of SEQ ID NOs.: 1–127 to inhibit proliferation.

Another embodiment of the present invention is a compound which interacts with a polypeptide whose expression is inhibited by an antisense nucleic acid comprising one of SEQ ID NOs.: 1–127 to inhibit proliferation.

Another embodiment of the present invention is a method for manufacturing an antibiotic comprising the steps of screening one or more candidate compounds to identify a compound that reduces the activity or level of a gene product required for proliferation, said gene product comprising a gene product whose activity or expression is inhibited by an antisense nucleic acid comprising a sequence selected from the group consisting of SEQ ID NOs.: 1–27 and manufacturing the compound so identified. The screening step may comprise performing any one of the methods of identifying a compound described above.

Another embodiment of the present invention is a method for inhibiting proliferation of a microorganism in a subject comprising administering a compound that reduces the activity or level of a gene product required for proliferation of said microorganism, said gene product comprising a gene product whose activity or expression is inhibited by an antisense nucleic acid comprising a sequence selected from the group consisting of SEQ ID NOs.: 1–127 to said subject. The method of subject may be selected from the group consisting of vertebrates, mammals, avians, and human beings. The gene product may comprise a polypeptide comprising a sequence selected from the group consisting of SEQ ID NOs.: 299–469.

DEFINITIONS

Figure 1:
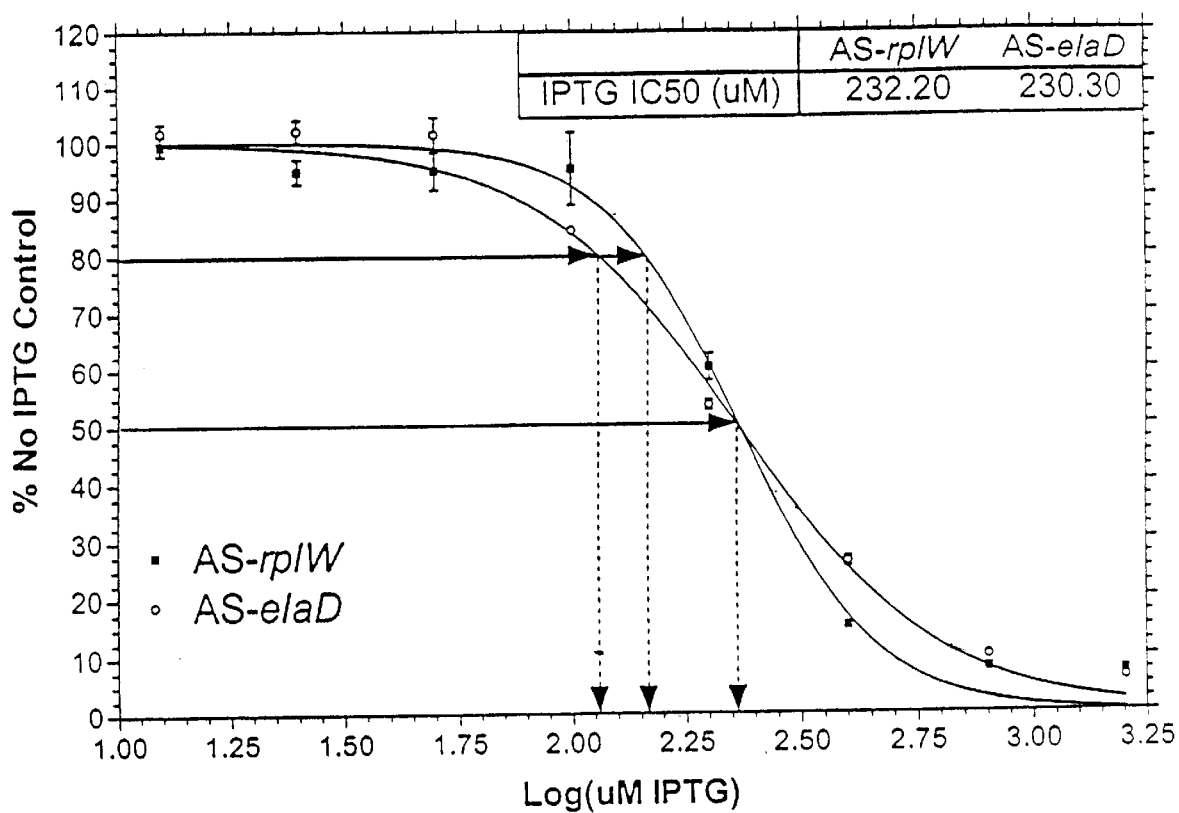
FIG. 1 is an IPTG dose response curve in *E. coli* transformed with an IPTG-inducible plasmid containing either an antisense clone to the *E. coli* ribosomal protein rplw (AS-rplW) which is required for protein synthesis and essential for cell proliferation, or an antisense clone to the elaD gene (AS-elaD) which is not known to be involved in protein synthesis and which is also essential for proliferation.

By "biological pathway" is meant any discrete cell function or process that is carried out by a gene product or a subset of gene products. Biological pathways include enzymatic, biochemical and metabolic pathways as well as pathways involved in the production of cellular structures such as cell walls. Biological pathways that are usually required for proliferation of microorganisms include, but are not limited to, cell division, DNA synthesis and replication, RNA synthesis (transcription), protein synthesis (translation), protein processing, protein transport, fatty acid biosynthesis, cell wall synthesis, cell membrane production, synthesis and maintenance, and the like.

By "inhibit activity of a gene or gene product" is meant having the ability to interfere with the function of a gene or gene product in such a way as to decrease expression of the gene or to reduce the level or activity of a product of the gene. Agents which inhibit the activity of a gene include agents that inhibit transcription of the gene, agents that inhibit processing of the transcript of the gene, agents that reduce the stability of the transcript of the gene, and agents that inhibit translation of the mRNA transcribed from the gene. In microorganisms, agents which inhibit the activity of a gene can act to decrease expression of the operon in which the gene resides or alter the folding or processing of operon RNA so as to reduce the level or activity of the gene product. The gene product can be a non-translated RNA such as ribosomal RNA, a translated RNA (mRNA) or the protein product resulting from translation of the gene mRNA. Of particular utility to the present invention are antisense RNAs that have activities against the operons or genes to which they specifically hybridze.

By "activity against a gene product" is meant having the ability to inhibit the function or to reduce the level or activity of the gene product in a cell.

By "activity against a protein" is meant having the ability to inhibit the function or to reduce the level or activity of the protein in a cell.

By "activity against a nucleic acid" is meant having the ability to inhibit the function or to reduce the level or activity of the nucleic acid in a cell.

By "activity against a gene" is meant having the ability to inhibit the function or expression of the gene in a cell.

By "activity against an operon" is meant having the ability to inhibit the function or reduce the level of one or more products of the operon in a cell.

By "antibiotic" is meant an agent which inhibits the proliferation of a microorganism.

By "identifying a compound" is meant to screen one or more compounds in a collection of compounds such as a combinatorial chemical library or other library of chemical compounds or to characterize a single compound by testing the compound in a given assay and determining whether it exhibits the desired activity.

By "inducer" is meant an agent or solution which, when placed in contact with a microorganism, increases transcription from a desired promoter.

As used herein, "nucleic acid" means DNA or RNA. Thus, the terminology "the nucleic acid of SEQ ID NO: X" includes both the DNA sequence of SEQ ID NO: X and an RNA sequence in which the thymidines in the DNA sequence have been substituted with uridines in the RNA sequence and in which the deoxyribose backbone of the DNA sequence has been substituted with a ribose backbone in the RNA sequence.

As used herein, "sublethal" means a concentration of an agent below the concentration required to inhibit all cell growth.

DETAILED DESCRIPTION OF THE INVENTION

The present invention describes a group of E. coli genes and gene families required for growth and/or proliferation. A proliferation-required gene or gene family is one where, in the absence of a gene transcript and/or gene product, growth or viability of the microorganism is reduced or eliminated. Thus, as used herein the terminology "proliferation-required" or "required for proliferation" encompasses sequences where the absence of a gene transcript and/or gene product completely eliminates cell growth as well as sequences where the absence of a gene transcript and/or gene product merely reduces cell growth. These proliferation-required genes can be used as potential targets for the generation of new antimicrobial agents. To achieve that goal, the present invention also encompasses novel assays for analyzing proliferation-required genes and for identifying compounds which interact with the gene products of the proliferation-required genes. In addition, the present invention contemplates the expression of genes and the purification of the proteins encoded by the nucleic acid sequences identified as required proliferation genes and reported herein. The purified proteins can be used to generate reagents and screen small molecule libraries or other candidate compound libraries for compounds that can be further developed to yield novel antimicrobial compounds.

The present invention also describes methods for identification of homologous genes in organisms other than E. coli.

The present invention utilizes a novel method to identify proliferation-required E. coli sequences. Generally, a library of nucleic acid sequences from a given source are subcloned or otherwise inserted into an inducible expression vector, thus forming an expression library. Although the insert nucleic acids may be derived from the chromosome of the organism into which the expression vector is to be introduced, because the insert is not in its natural chromosomal location, the insert nucleic acid is an exogenous nucleic acid for the purposes of the discussion herein. The term expression is defined as the production of an RNA molecule from a gene, gene fragment, genomic fragment, or operon. Expression can also be used to refer to the process of peptide or polypeptide synthesis. An expression vector is defined as a vehicle by which a ribonucleic acid (RNA) sequence is transcribed from a nucleic acid sequence carried within the expression vehicle. The expression vector can also contain features that permit translation of a protein product from the transcribed RNA message expressed from the exogenous nucleic acid sequence carried by the expression vector. Accordingly, an expression vector can produce an RNA molecule as its sole product or the expression vector can produce a RNA molecule that is ultimately translated into a protein product.

Once generated, the expression library containing the exogenous nucleic acid sequences is introduced into an E. coli population to search for genes that are required for bacterial proliferation. Because the library molecules are foreign to the population of E. coli, the expression vectors and the nucleic acid segments contained therein are considered exogenous nucleic acid.

Expression of the exogenous nucleic acid fragments in the test population of E. coli containing the expression vector library is then activated. Activation of the expression vectors consists of subjecting the cells containing the vectors to conditions that result in the expression of the exogenous nucleic acid sequences carried by the expression vector library. The test population of E. coli cells is then assayed to determine the effect of expressing the exogenous nucleic acid fragments on the test population of cells. Those expression vectors that, upon activation and expression, negatively impact the growth of the E. coli screen population were identified, isolated, and purified for further study.

A variety of assays are contemplated to identify nucleic acid sequences that negatively impact growth upon expression. In one embodiment, growth in E. coli cultures expressing exogenous nucleic acid sequences and growth in cultures not expressing these sequences is compared. Growth measurements are assayed by examining the extent of growth by measuring optical densities. Alternatively, enzymatic assays can be used to measure bacterial growth rates to identify exogenous nucleic acid sequences of interest. Colony size, colony morphology, and cell morphology are additional factors used to evaluate growth of the host cells. Those cultures that failed to grow or grow with reduced efficiency under expression conditions are identified as containing an expression vector encoding a nucleic acid fragment that negatively affects a proliferation-required gene.

Once exogenous nucleic acid sequences of interest are identified, they are analyzed. The first step of the analysis is to acquire the nucleic acid sequence of the nucleic acid fragment of interest. To achieve this end, the insert in those expression vectors identified as containing a sequence of interest is sequenced, using standard techniques well known in the art. The next step of the process is to determine the source of the nucleic acid sequence.

Determination of sequence source is achieved by comparing the obtained sequence data with known sequences in various genetic databases. The sequences identified are used to probe these gene databases. The result of this procedure is a list of exogenous nucleic acid sequences corresponding to a list that includeds novel bacterial genes required for proliferation as well as genes previously identified as required for proliferation.

The number of DNA and protein sequences available in database systems has been growing exponentially for years. For example, at the end of 1998, the complete sequences of *Caenorhabditis elegans, Saccharomyces cerevisiae* and nineteen bacterial genomes, including *E. coli* were available. This sequence information is stored in a number of databanks, such as GenBank (the National Center for Biotechnology Information (NCBI), and is publicly available for searching.

A variety of computer programs are available to assist in the analysis of the sequences stored within these databases. FastA, (W. R. Pearson (1990) "Rapid and Sensitive Sequence Comparison with FASTP and FASTA" Methods in Enzymology 183:63–98), Sequence Retrieval System (SRS), (Etzold & Argos, SRS an indexing and retrieval tool for flat file data libraries. Comput. Appl. Biosci. 9:49–57, 1993) are two examples of computer programs that can be used to analyze sequences of interest. In one embodiment of the present invention, the BLAST family of computer programs, which includes BLASTN version 2.0 with the default parameters, or BLASTX version 2.0 with the default parameters, is used to analyze nucleic acid sequences.

BLAST, an acronym for "Basic Local Alignment Search Tool," is a family of programs for database similarity searching. The BLAST family of programs includes: BLASTN, a nucleotide sequence database searching program, BLASTX, a protein database searching program where the input is a nucleic acid sequence; and BLASTP, a protein database searching program. BLAST programs embody a fast algorithm for sequence matching, rigorous statistical methods for judging the significance of matches, and various options for tailoring the program for special situations. Assistance in using the program can be obtained by e-mail at blast@ncbi.nlm.nih.gov.

Bacterial genes are often transcribed in polycistronic groups. These groups comprise operons, which are a collection of genes and intergenic sequences. The genes of an operon are co-transcribed and are often related finctionally. Given the nature of the screening protocol, it is possible that the identified exogenous nucleic acid sequence corresponds to a gene or portion thereof with or without adjacent noncoding sequences, an intragenic sequence (i.e. a sequence within a gene), an intergenic sequence (i.e. a sequence between genes), a sequence spanning at least a portion of two or more genes, a 5' noncoding region or a 3' noncoding region located upstream or downstream from the actual sequence that is required for bacterial proliferation. Accordingly, determining which of the genes that are encoded within the operons are individually required for proliferation is often desirable.

In one embodiment of the present invention, an operon is dissected to determine which gene or genes are required for proliferation. For example, the RegulonDB DataBase described by Huerta et al. (*Nucl. Acids Res.* 26:55–59, 1998), which may also be found on the website http://www.cifn.unam.mx/Computational_Biology/regulondb/, may be used. to identify the boundaries of operons encoded within microbial genomes. A number of techniques that are well known in the art can be used to dissect the operon. In one aspect of this embodiment, gene disruption by homologous recombination is used to individually inactivate the genes of an operon that is thought to contain a gene required for proliferation.

Several gene disruption techniques have been described for the replacement of a functional gene with a mutated, non-functional (null) allele. These techniques generally involve the use of homologous recombination. The method described by Link et al. (J. Bacteriol 1997 179:6228; incorporated herein by reference in it's entirety) serves as an excellent example of these methods as applicable to disruption of genes in *E. coli*. This technique uses crossover PCR to create a null allele with an in-frame deletion of the coding region of a target gene. The null allele is constructed in such a way that sequences adjacent to the wild type gene (ca. 500 bp) are retained. These homologous sequences surrounding the deletion null allele provide targets for homologous recombination so that the wild type gene on the *E. coli* chromosome can be replaced by the constructed null allele.

The crossover PCR amplification product is subcloned into the vector pKO3, the features of which include a chloramphenicol resistance gene, the counter-selectable marker sacB, and a temperature sensitive autonomous replication function. Following transformation of an *E. coli* cell population with such a vector, selection for cells that have undergone homologous recombination of the vector into the chromosome is achieved by growth on chloramphenicol at the non-permissive temperature of 43° C. Under these conditions, autonomous replication of the plasmid cannot occur and cell are resistant to chlorophinicol only if the chloramphenicol resistance gene has been integrated into the chromosome. Usually a single crossover event is responsible for this integration event such that the *E. coli* chromosome now contains a tandem duplication of the target gene consisting of one wild type allele and one deletion null allele separated by vector sequence.

This new *E. coli* strain containing the tandem duplication can be maintained at permissive temperatures in the presence of drug selection (chloramphenicol). Subsequently, cells of this new strain are cultured at the permissive temperature 30° C. without drug selection. Under these conditions, the chromosome of some of the cells within the population will have undergone an internal homologous recombination event resulting in removal of the plasmid sequences. Subsequent culturing of the strain in growth medium lacking chloramphenicol but containing sucrose is used to select for such recombinative resolutions. In the presence of the counter-selectable marker sacB, sucrose is rendered into a toxic metabolite. Thus, cells that survive this counter-selection have lost both the plasmid sequences from the chromosome and the autonomously replicating plasmid that results as a byproduct of recombinative resolution.

There are two possible outcomes of the above recombinative resolution via homologous recombination. Either the wild type copy of the targeted gene is retained on the chromosome or the mutated null allele is retained on the chromosome. In the case of an essential gene, a single copy of the null allele would be lethal and such cells should not be obtained by the above procedure when applied to essential genes. In the case of a non-essential gene, roughly equal numbers of cells containing null alleles and cells containing wild type alleles should be obtained. Thus, the method serves as a test for essentiality of the targeted gene: when applied to essential genes, only cells with a wild type allele on the chromosome will be obtained.

Other techniques have also been described for the creation of disruption mutations in *E. coli*. For example, Link et al. also describe inserting an in-frame sequence tag concommitantly with an in-frame deletion in order to simplify analysis of recombinants obtained. Further, Link et al. describe disruption of genes with a drug resistance marker such as a kanamycin resistance gene. Arigoni et al., (Arigoni, F. et al. A Genome-based Approach for the Identification of Essential Bacterial Genes, Nature Biotechnology 16: 851–856, the disclosure of which is incorporated herein by reference in its entirety) describe the use of gene disruption combined with engineering a second copy of a test gene such that the expression of the gene is regulated by and inducible promoter such as the arabinose promoter to test the essentiality of the gene. Many of these techniques result in the insertion of large fragments of DNA into the gene of interest, such as a drug selection marker. An advantage of the technique described by Link et al. is that it does not rely on an insertion into the gene to cause a functional defect, but rather results in the precise removal of the coding region. This insures the lack of polar effects on the expression of genes downstream from the target gene.

Recombinant DNA techniques can be used to express the entire coding sequences of the gene identified as required for proliferation, or portions thereof. The over-expressed proteins can be used as reagents for further study. The identified exogenous sequences are isolated, purified, and cloned into a suitable expression vector using methods well known in the art. If desired, the nucleic acids can contain the sequences encoding a signal peptide to facilitate secretion of the expressed protein.

Expression of fragments of the bacterial genes identified as required for proliferation is also contemplated by the present invention. The fragments of the identified genes can encode.a polypeptide comprising at least 5, at least 10, at least 15, at least 20, at least 25, at least 30, at least 35, at least 40, at least 45, at least 50, at least 55, at least 60, at least 65, at least 75, or more than 75 consecutive amino acids of a gene complementary to one of the identified sequences of the present invention. The nucleic acids inserted into the expression vectors can also contain sequences upstream and downstream of the coding sequence.

When expressing the coding sequence of an entire gene identified as required for bacterial proliferation or a fragment thereof, the nucleic acid sequence to be expressed is operably linked to a promoter in an expression vector using conventional cloning technology. The expression vector can be any of the bacterial, insect, yeast, or mammalian expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon usage and codon bias of the sequence can be optimized for the particular expression organism in which the expression vector is introduced, as explained by Hatfield, et al., U.S. Pat. No. 5,082,767, incorporated herein by this reference. Fusion protein expression systems are also contemplated by the present invention.

Following expression of the protein encoded by the identified exogenous nucleic acid sequence, the protein is purified. Protein purification techniques are well known in the art. Proteins encoded and expressed from identified exogenous nucleic acid sequences can be partially purified using precipitation techniques, such as precipitation with polyethylene glycol. Chromatographic methods usable with the present invention can include ion-exchange chromatography, gel filtration, use of hydroxyapaptite columns, immobilized reactive dyes, chromatofocusing, and use of high-performance liquid chromatography. Electrophoretic methods such one-dimensional gel electrophoresis, high-resolution two-dimensional polyacrylamide electrophoresis, isoelectric focusing, and others are contemplated as purification methods. Also, affinity chromatographic methods, comprising antibody columns, ligand presenting columns and other affinity chromatographic matrices are contemplated as purification methods in the present invention.

The purified proteins produced from the gene coding sequences identified as required for proliferation can be used in a variety of protocols to generate useful antimicrobial reagents. In one embodiment of the present invention, antibodies are generated against the proteins expressed from the identified exogenous nucleic acid sequences. Both monoclonal and polyclonal antibodies can be generated against the expressed proteins. Methods for generating monoclonal and polyclonal antibodies are well known in the art. Also, antibody fragment preparations prepared from the produced antibodies discussed above are contemplated.

Another application for the purified proteins of the present invention is to screen small molecule libraries for candidate compounds active against the various target proteins of the present invention. Advances in the field of combinatorial chemistry provide methods, well known in the art, to produce large numbers of candidate compounds that can have a binding, or otherwise inhibitory effect on a target protein. Accordingly, the screening of small molecule libraries for compounds with binding affinity or inhibitory activity for a target protein produced from an identified gene sequence is contemplated by the present invention.

The present invention further contemplates utility against a variety of other pathogenic organisms in addition to *E. coli*. For example, the invention has utility in identifying genes required for proliferation in prokaryotes and eukaryotes. For example, the invention has utility with protists, such as Plasmodium spp.; plants; animals, such as Entamoeba spp. and Contracaecum spp; and fungi including Candida spp., (e.g., *Candida albicans*), *Saccharomyces cerevisiae, Cryptococcus neoformans*, and *Aspergillus fumigatus*. In one embodiment of the present invention, monera, specifically bacteria are probed in search of novel gene sequences required for proliferation. This embodiment is particularly important given the rise of drug resistant bacteria.

The numbers of bacteria species that are becoming resistant to existing antibiotics are growing. A partial list of these organisms includes: Staphylococcus spp., such as *S. aureus*; Enterococcus spp., such as *E. faecalis*; Pseudomonas spp., such as *P. aeruginosa*, Clostridium spp., such as *C. botulinum*, Haemophilus spp., such as *H. influenzae*, Enterobacter spp., such as *E. cloacae*, Vibrio spp., such as *V. cholera*; Moraxala spp., such as *M catarrhalis*; Streptococcus spp., such as *S. pneumoniae*, Neisseria spp., such as *N. gonorrhoeae*; Mycoplasma spp., such as *Mycoplasma pneumoniae; Salmonella typhimurium; Helicobacter pylori; Escherichia coli*; and *Mycobacterium tuberculosis*. The sequences identified as required for proliferation in the present invention can be used to probe these and other organisms to identify homologous required proliferation genes contained therein.

In one embodiment of the present invention, the nucleic acid sequences disclosed herein are used to screen genomic libraries generated from bacterial species of interest other than *E. coli*. For example, the genomic library may be from *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni, Chlamydia trachomatus, Chlamydia pneumoniae* or any species falling within the genera of any of the above species. Standard molecular biology techniques are used to generate genomic libraries from various microorganisms. In one aspect, the libraries are generated and bound to nitrocellulose paper. The identified exogenous nucleic acid sequences of the present invention can then be used as probes to screen the libraries for homologous sequences. The homologous sequences identified can then be used as targets for the identification of new, antimicrobial compounds with activity against more than one organism.

For example, the preceding methods may be used to isolate nucleic acids having a sequence with at least 97%, at least 95%, at least 90%, at least 85%, at least 80%, or at least 70% identity to a nucleic acid sequence selected from the group consisting of one of the sequences of SEQ ID NOS. 1–127, 128–298, fragments comprising at least 10, 15, 20, 25, 30, 35, 40, 50, 75, 100, 150, 200, 300, 400, or 500 consecutive bases thereof, and the sequences complementary thereto. Identity may be measured using BLASTN version 2.0 with the default parameters. (Altschul, S. F. et al. Gapped BLAST and PSI-BLAST: A New Generation of Protein Database Search Programs, *Nucleic Acid Res*. 25: 3389–3402 (1997), the disclosure of which is incorporated herein by reference in its entirety). For example, the homologous polynucleotides may have a coding sequence which is a naturally occurring allelic variant of one of the coding sequences described herein. Such allelic variants may have a substitution, deletion or addition of one or more nucleotides when compared to the nucleic acids of SEQ ID NOs: 1–127, 128–298 or the sequences complementary thereto.

Additionally, the above procedures may be used to isolate nucleic acids which encode polypeptides having at least 99%, 95%, at least 90%, at least 85%, at least 80%, at least 70%, at least 60%, at least 50%, or at least 40% identity or similarity to a polypeptide having the sequence of one of SEQ ID NOs: 299–469 or fragments comprising at least 5, 10, 15, 20, 25, 30, 35, 40, 50, 75, 100, or 150 consecutive amino acids thereof as determined using the FASTA version 3.0t78 algorithm with the default parameters. Alternatively, protein identity or similarity may be identified using BLASTP with the default parameters, BLASTX with the default parameters, or TBLASTN with the default parameters. (Alschul, S.F. et al. Gapped BLAST and PSI-BLAST: A New Generation of Protein Database Search Programs, *Nucleic Acid Res*. 25: 3389–3402 (1997), the disclosure of which is incorporated herein by reference in its entirety).

Alternatively, homologous nucleic acids or polypeptides may be identified by searching a database to identify sequences having a desired level of homology to a nucleic acid or polypeptide involved in proliferation or an antisense nucleic acid to a nucleic acid involved in microbial proliferation. A variety of such databases are available to those skilled in the art, including GenBank and GenSeq. In some embodiments, the databases are screened to identify nucleic acids or polypeptides having at least 97%, at least 95%, at least 90%, at least 85%, at least 80%, at least 70%, at least 60%, or at least 50%, at least 40% identity or similarity to a nucleic acid or polypeptide involved in proliferation or an antisense nucleic acid involved in proliferation. For example, the database may be screened to identify nucleic acids homologous to one of SEQ ID Nos. 1–127, 128–298 or polypeptides homologous to SEQ ID NOs. 299–469. In some embodiments, the database may be screened to identify homologous nucleic acids or polypeptides from organisms other than *E. coli*, including organisms such as *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, Bacillus anthracis, Yersinia pestis, Clostridium botulinum, Campylobacter jejuni, Chlamydia trachomatus, Chlamydia pneumoniae* or any species falling within the genera of any of the above species.

In another embodiment, gene expression arrays and microarrays can be employed. Gene expression arrays are high density arrays of DNA samples deposited at specific locations on a glass chip, nylon membrane, or the like. Such arrays can be used by researchers to quantify relative gene expression under different conditions. Gene expression arrays are used by researchers to help identify optimal drug targets, profile new compounds, and determine disease pathways. An example of this technology is found in U.S. Pat. No. 5,807,522, which is hereby incorporated by reference.

It is possible to study the expression of all genes in the genome of a particular microbial organism using a single array. For example, the arrays from Genosys consist of 12×24 cm nylon filters containing PCR products corresponding to 4290 ORFs from *E. coli*. 10 ngs of each are spotted every 1.5 mm on the filter. Single stranded labeled cDNAs are prepared for hybridization to the array (no second strand synthesis or amplification step is done) and placed in contact with the filter. Thus the labeled cDNAs are of "antisense" orientation. Quantitative analysis is done by phosphorimager.

Hybridization of cDNA made from a sample of total cell mRNA to such an array followed by detection of binding by one or more of various techniques known to those in the art results in a signal at each location on the array to which cDNA hybridized. The intensity of the hybridization signal obtained at each location in the array thus reflects the amount of mRNA for that specific gene that was present in the sample. Comparing the results obtained for mRNA isolated from cells grown under different conditions thus allows for a comparison of the relative amount of expression of each individual gene during growth under the different conditions.

Gene expression arrays may be used to analyze the total mRNA expression pattern at various time points after induction of an antisense nucleic acid against a proliferation-required gene. Analysis of the expression pattern indicated by hybridization to the array provides information on whether or not the target gene of the antisense nucleic acid is being affected by antisense induction, how quickly the antisense is affecting the target gene, and for later timepoints, what other genes are affected by antisense expression. For example, if the antisense is directed against a gene for ribosomal protein L7/L12 in the 50S subunit, its targeted mRNA may disappear first and then other mRNAs may be observed to increase, decrease or stay the same. Similarly, if the antisense is directed against a different 50S subunit ribosomal protein mRNA (e.g. L25), that mRNA may disappear first followed by changes in mRNA expression that are similar to those seen with the L7/L12 antisense expression. Thus, the mRNA expression pattern observed with an antinsense nucleic acid against a proliferation required gene may identify other proliferation-required nucleic acids in the same pathway as the target of the antisense nucleic acid. In addition, the mRNA expression patterns observed with candidate drug compounds may be compared to those observed with antisense nucleic acids against a proliferation-required nucleic acid. If the mRNA expression pattern observed with the candidate drug compound is similar to that observed with the antisense nucleic acid, the drug compound may be a promising therapeutic candidate. Thus, the assay would be useful in assisting in the selection of candidate drug compounds for use in screening methods such as those described below.

In cases where the source of nucleic acid deposited on the array and the source of the nucleic acid being hybridized to the array are from two different organisms, gene expression arrays can identify homologous genes in the two organisms.

The present invention also contemplates additional methods for screening other microorganisms for proliferation-required genes. In this embodiment, the conserved portions of sequences identified as proliferation-required can be used to generate degenerate primers for use in the polymerase chain reaction (PCR). The PCR technique is well known in the art. The successful production of a PCR product using degenerate probes generated from the sequences identified herein would indicate the presence of a homologous gene sequence in the species being screened. This homologous gene is then isolated, expressed, and used as a target for candidate antibiotic compounds. In another aspect of this embodiment, the homologous gene is expressed in an autologous organism or in a heterologous organism in such a way as to alter the level or activity of a homologous gene required for proliferation in the autologous or heterologus organism. In still another aspect of this embodiment, the homologous gene or portion is expressed in an antisense orientation in such a way as to alter the level or activity of a nucleic acid required for proliferation of an autologous or heterologous organism.

The homologous sequences to proliferation-required genes identified using the techniques described herein may be used to identify proliferation-required genes of organisms other than *E. coli*, to inhibit the proliferation of organisms other than *E. coli* by inhibiting the activity or reducing the amount of the identified homologous nucleic acid or polypeptide in the organism other than *E. coli*, or to identify compounds which inhibit the growth of organisms other than *E. coli* as described below.

In another embodiment of the present invention, *E. coli* sequences identified as required for proliferation are transferred to expression vectors capable of function within non-*E. coli* species. As would be appreciated by one of ordinary skill in the art, expression vectors must contain certain elements that are species specific. These elements can include promoter sequences, operator sequences, repressor genes, origins of replication, ribosomal binding sequences, termination sequences, and others. To use the identified exogenous sequences of the present invention, one of ordinary skill in the art would know to use standard molecular biology techniques to isolate vectors containing the sequences of interest from cultured bacterial cells, isolate and purify those sequences, and subclone those sequences into an expression vector adapted for use in the species of bacteria to be screened.

Expression vectors for a variety of other species are known in the art. For example, Cao et al. report the expression of steroid receptor fragments in *Staphylococcus aureus*. J. Steroid Biochem Mol Biol. 44 (1):1–11(1993). Also, Pla et al. have reported an expression vector that is functional in a number of relevant hosts including: *Salmonella typhimurium*, *Pseudomonas putida*, and *Pseudomonas aeruginosa*. J. Bacteriol. 172(8):4448–55 (1990). These examples demonstrate the existence of molecular biology techniques capable of constructing expression vectors for the species of bacteria of interest to the present invention.

Following the subcloning of the identified nucleic acid sequences into an expression vector functional in the microorganism of interest, the identified nucleic acid sequences are conditionally transcribed to assay for bacterial growth inhibition. Those expression vectors found to contain sequences that, when transcribed, inhibit bacterial growth are compared to the known genomic sequence of the pathogenic microorganism being screened or, if the homologous sequence from the organism being screened is not known, it may be identified and isolated by hybridization to the proliferation-required *E. coli* sequence interest or by amplification using primers based on the proliferation-required *E. coli* sequence of interest as described above.

The antisense sequences from the second organism which are identified as described above may then be operably linked to a promoter, such as an inducible promoter, and introduced into the second organism. The techniques described herein for identifying *E. coli* genes required for proliferation may thus be employed to determine whether the identified sequences from a second organism inhibit the proliferation of the second organism.

Antisense nucleic acids required for the proliferation of organisms other than *E. coli* or the genes corresponding thereto, may also be hybridized to a microarray containing the *E. coli* ORFs to gauge the homology between the *E. coli* sequences and the proliferation-required nucleic acids from other organisms. For example, the proliferation-required nucleic acid may be from *Staphylococcus aureus, Pseudomonas aeruginosa, Enterobacter cloacae, Helicobacter pylori, Neisseria gonorrhoeae, Enterococcus faecalis, Streptococcus pneumoniae, Haemophilus influenzae, Salmonella typhimurium, Saccharomyces cerevisiae, Candida albicans, Cryptococcus neoformans, Aspergillus fumigatus, Klebsiella pneumoniae, Salmonella typhi, Salmonella paratyphi, Salmonella cholerasuis, Staphylococcus epidermidis, Mycobacterium tuberculosis, Mycobacterium leprae, Treponema pallidum, bacillus anthracis, Yersinia pestis, Clostridium botulinum, Campylobacter jejuni or Chlamydia trachomatus, Chlamydia pneumoniae* or any species falling within the genera of any of the above species. The proliferation-required nucleic acids from an organism other than *E. coli* may be hybridized to the array under a variety of conditions which permit hybridization to occur when the probe has different levels of homology to the sequence on the microarray. This would provide an indication of homology across the organisms as well as clues to other possible essential genes in these organisms.

In still another embodiment, the exogenous nucleic acid sequences of the present invention that are identified as required for bacterial growth or proliferation can be used as antisense therapeutics for killing bacteria. The antisense sequences can be directed against the proliferation-required genes whose sequence corresponds to the exogenous nucleic acid probes identified here (i.e. the antisense nucleic acid may hybridize to the gene or a portion thereof). Alternatively, antisense therapeutics can be directed against operons in which proliferation-required genes reside (i.e. the antisense nucleic acid may hybridize to any gene in the operon in which the proliferation-required genes reside). Further, antisense therapeutics can be directed against a proliferation-required gene or portion thereof with or without adjacent noncoding sequences, an intragenic sequence (i.e. a sequence within a gene), an intergenic sequence (i.e. a sequence between genes), a sequence spanning at least a portion of two or more genes, a 5' noncoding region or a 3' noncoding region located upstream or downstream from the actual sequence that is required for bacterial proliferation or an operon containing a proliferation-required gene.

In addition to therapeutic applications, the present invention encompasses the use of nucleic acid sequences complementary to sequences required for proliferation as diagnostic tools. For example, nucleic acid probes complementary to proliferation-required sequences that are specific for particular species of microorganisms can be used as probes to identify particular microorganism species in clinical specimens. This utility provides a rapid and dependable method by which to identify the causative agent or agents of a bacterial infection. This utility would provide clinicians the ability to prescribe species specific antimicrobial compounds to treat such infections. In an extension of this utility, antibodies generated against proteins translated from mRNA transcribed from proliferation-required sequences can also be used to screen for specific microorganisms that produce such proteins in a species-specific manner.

The following examples teach the genes of the present invention and a subset of uses for the E. coli genes identified as required for proliferation. These examples are illustrative only and are not intended to limit the scope of the present invention.

EXAMPLES

The following examples are directed to the identification and exploitation of E. coli genes required for proliferation. Methods of gene identification are discussed as well as a variety of methods to utilize the identified sequences.

Genes Identified as Required for Proliferation of E. coli

Exogenous nucleic acid sequences were cloned into an inducible expression vector and assayed for growth inhibition activity. Example 1 describes the examination of a library of exogenous nucleic acid sequences cloned into the IPTG-inducible expression vector pLex5BA (Krause et al., J. Mol. Biol. 274: 365 (1997), the disclosure of which is incorporated herein by reference in its entirety). Upon activation or induction, the expression vectors produced an RNA molecule corresponding to the subcloned exogenous nucleic acid sequences. The RNA product was in an antisense orientation with respect to the E. coli genes from which it was originally derived. This antisense RNA then interacted with sense mRNA produced from various E. coli genes and interfered with or inhibited the translation of the sense messenger RNA (mRNA) thus preventing protein production from these sense mRNA molecules. In cases where the sense mRNA encoded a protein required for the proliferation, bacterial cells containing an activated expression vector failed to grow or grew at a substantially reduced rate. Similar results have also be obtained in cases where the gene encodes a non-translated RNA, such as a ribosomal RNA.

Example 1

Inhibition of Bacterial Proliferation after IPTG Induction

To study the effects of transcriptional induction in liquid medium, growth curves were carried out by back diluting cultures 1:200 into fresh media with or without 1 mM IPTG and measuring the $OD_{450}$ every 30 minutes (min). To study the effects of transcriptional induction on solid medium, $10^2$, $10^3$, $10^4$, $10^5$, $10^6$, $10^7$ and $10^8$ fold dilutions of overnight cultures were prepared. Aliquots of from 0.5 to 3 $\mu$l of these dilutions were spotted on selective agar plates with or without 1 mM IPTG. After overnight incubation, the plates were compared to assess the sensitivity of the clones to IPTG.

Of the numerous clones tested, some clones were identified as containing a sequence that inhibited E. coli growth after IPTG induction. Accordingly, the gene to which the inserted nucleic acid sequence corresponds, or a gene within the operon containing the inserted nucleic acid, may be required for proliferation in E. coli.

Characterization of Isolated Clones Negatively Affecting E. coli Proliferation

Following the identification of those expression vectors that, upon expression, negatively impacted E. coli growth or proliferation, the inserts or nucleic acid fragments contained in those expression vectors were isolated for subsequent characterization. Inserts in expression vectors of interest were subjected to nucleic acid sequence determination.

Example 2

Nucleic Acid Sequence Determination of Identified Clones Expressing Nucleic Acid Fragments with Detrimental Effects of E. coli Proliferation The nucleotide sequences for the exogenous identified sequences were determined using plasmid DNA isolated using QIAPREP (Qiagen, Valencia, Calif.) and methods supplied by the manufacturer. The primers used for sequencing the inserts were 5'-TGTTTATCAGACCGCTT-3' (SEQ ID NO: 1) and 5'-ACAATTTCACACAGCCTC-3' (SEQ ID NO: 2). These sequences flank the polylinker in pLEX5BA. Sequence identification numbers (SEQ ID NOs) for the identified inserts are listed in Table I and discussed below.

Example 3

Comparison of Isolated Sequences to Known Sequences

The nucleic acid sequences of the subcloned fragments obtained from the expression vectors discussed above were compared to known E. coli sequences in GenBank using BLAST version 1.4 or version 2.0.6 using the following default parameters: Filtering off, cost to open a gap=5, cost to extend a gap=2, penalty for a mismatch in the blast portion of run=−3, reward for a match in the blast portion of run=1, expectation value (e)=10.0, word size=11, number of one-line descriptions=100, number of alignments to show (B)=100. BLAST is described in Altschul, J Mol Biol. 215:403–10 (1990), the disclosure of which is incorporated herein by reference in its entirety. Expression vectors were found to contain nucleic acid sequences in both the sense and antisense orientations. The presence of known genes, open reading frames, and ribosome binding sites was determined by comparison to public databases holding genetic information and various computer programs such as the Genetics Computer Group programs FRAMES and CODONPREFERENCE. Clones were designated as "antisense" if the cloned fragment was oriented to the promoter such that the RNA transcript produced was complementary to the expressed mRNA from a chromosomal locus. Clones were designated as "sense" if they coded for an RNA fragment that was identical to a portion of a wild type mRNA from a chromosomal locus.

The sequences described in Examples 1–2 that inhibited bacterial proliferation and contained gene fragments in an antisense orientation are listed in Table I. This table lists each identified sequence by: a sequence identification number; a Molecule Number; a gene to which the identified sequence corresponds, listed according to the National Center for Biotechnology Information (NCBI), Blattner (Science 277:1453–1474 (1997); also contains the *E. coli* K-12 genome sequence), or Rudd (Micro. and Mol. Rev. 62:985–1019 (1998)), (both papers are hereby incorporated by reference) nomenclatures. The CONTIG numbers for each identified sequence is shown, as well as the location of the first and last base pairs located on the *E. coli* chromosome. A Molecule Number with a "*" indicates a clone corresponding to an intergenic sequence.

TABLE I

Identified Clones with Corresponding Genes and Operons

| Clone Name | Seq ID | Molecule No. | Gene (NCBI) | Gene (Blattner) | Gene (Rudd) | Contig | Start | Stop |
|---|---|---|---|---|---|---|---|---|
| 626.O24 | 1 | EcXA056 | f320 | b1113 | ycfS | AE000211 | 7631 | 7971 |
| E1M10000116B1 | 2 | EcXA056b | ycfS | b1113 | ycfS | AE000211 | 7658 | 7847 |
| E1M10000155F12 | 3 | EcXA056c | ycfS | b1113 | ycfS | AE000211 | 7649 | 8037 |
| Z56-D2 | 4 | EcXA057 | arp | b4017 | arp | AE000474 | 14059 | 14440 |
| E1M10000144B6 | 5 | EcXA057b | arp | b4017 | arp | AE000474 | 14187 | 14385 |
| Z60-P16 | 6 | EcXA058 | rplC | b3320 | rplC | AE000408 | 10002 | 10338 |
| Z80-D10 | 7 | EcXA059 | ypjA | b2647 | ypjA | AE000349 | 10402 | 10493 |
|  |  |  |  |  |  | AE000350 | 1 | 728 |
| P33-1.C22 | 8 | EcXA060 | rplR | b3304 | rplR | AE000408 | 2763 | 2958 |
| E1M10000161C06 | 9 | EcXA060b | RplR; rplF | b3304; b3305 | RplR; rplF | AE000408 | 3006 | 3477 |
| P35-7 | 10 | EcXA061 | malE | b4034 | malE | AE000476 | 11925 | 12089 |
| P35-8 | 11 | EcXA062 | rep | b3778 | rep | AE000454 | 4438 | 4111 |
| P38-1.G20 | 12 | EcXA063 | elaD | b2269 | elaD | AE000316 | 9912 | 9581 |
| E1M10000107H4 | 13 | EcXA063b | elaD | b2269 | elaD | AE000316 | 9520 | 9389 |
| E1M10000122B03 | 14 | EcXA063c | elaD | b2269 | elaD | AE000316 | 9979 | 9715 |
| E1M10000139B07 | 15 | EcXA063d | elaD | b2269 | elaD | AE000316 | 10171 | 9533 |
| E1M10000152G3 | 16 | EcXA063e | elaD | b2269 | elaD | AE000316 | 9535 | 9406 |
| E1M10000143G03 | 17 | EcXA063f | elaD | b2269 | elaD | AE000316 | 10104 | 9869 |
| E1M10000131H01 | 18 | EcXA063h | elaD | b2269 | elaD | AE000316 | 9953 | 9746 |
| P319-4.O6 | 19 | EcXA064 | CyoE | b0428 | cyoE | AE000149 | 2140 | 2293 |
| P323-1.M10 | 20 | EcXA065 | DgoA | b3692 | YidU | AE000446 | 6005 | 6272 |
| E1M10000111E4 | 21 | EcXA065b | DgoA | b3692 | YidU | AE000446 | 6005 | 6133 |
| P323-8.P1 | 22 | EcXA066 | RpmI | b1717 | RpmI | AE000266 | 10240 | 10390 |
| E1M10000137G09 | 23 | EcXA066b | RplT;rpmI | b1716; b1717 | RplT; RpmI | AE000266 | 9947 | 10525 |
| P326-22.E17 | 24 | EcXA067 | xylF | b3566 | XylF | AE000434 | 288 | 95 |
| P326-9.K2 | 25 | EcXA068 | YhfL; yhfM | b3369; b3370 | yhfL; yhfM | AE000413 | 581 | 306 |
| P327-50.M10 | 26 | EcXA069 | RplD; rplC | b3319; b3320 | rplD; rplC | AE000408 | 9747 | 9900 |
| E1M10000110G1 | 27 | EcXA069b | RplD; rplC | b3319; b3320 | rplD; rplC | AE000408 | 9789 | 9933 |
| E1M10000121D08 | 28 | EcXA069c | RplD; rplC | b3319; b3320 | RplD; rplC | AE000408 | 9737 | 10002 |
| E1M10000136H1 | 29 | EcXA069d | RplD; rplC | b3319; b3320 | RplD; rplC | AE000408 | 9707 | 10241 |
| E1M10000126E08 | 30 | EcXA069e | rplC | b3320 | RplC | AE000408 | 10157 | 10379 |
| E1M10000137C04 | 31 | EcXA069f | RplD; rplC | b3319; b3320 | RplD; RplC | AE000408 | 9783 | 10007 |
| E1M10000106G02 | 32 | EcXA069g | rplC | b3320 | RplC | AE000408 | 9814 | 10154 |
| E1M10000146H01 | 33 | EcXA069h | RplD; rplC | b3319; b3320 | RplD; RplC | AE000408 | 9715 | 9890 |
| E1M10000148C02 | 34 | EcXA069i | Rp1D; rplC | b3319; b3320 | RplD; RplC | AE000408 | 9740 | 9980 |
| P328-20.P20 | 35 | EcXA070 | YbcQ | b0551 | YbcQ | AE000160 | 7883 | 7661 |
| 1065-12 | 36 | EcXA071 | ffh | b2610 | Ffh | AE000346 | 11978 | 12129 |
|  |  |  |  |  |  | AE000347 | 1 | 319 |
| E1M10000101D6 | 37 | EcXA071b | RpsP; ffh | b2609; b2610 | RpsP; ffh | AE000346 | 11911 | 12129 |
|  |  |  |  |  |  | AE000347 | 1 | 348 |
| P332-11.C20 | 38 | EcXA072 | recJ | b2892 | recJ | AE000372 | 12047 | 12144 |
|  |  |  |  |  |  | AE000273 | 1 | 108 |
| P334-5.H2 | 39 | EcXA073 | htrE | b0139 | htrE | AE000123 | 5431 | 5548 |

TABLE I-continued

Identified Clones with Corresponding Genes and Operons

| Clone Name | Seq ID | Molecule No. | Gene (NCBI) | Gene (Blattner) | Gene (Rudd) | Contig | Start | Stop |
|---|---|---|---|---|---|---|---|---|
| P338-4.M21 | 40 | EcXA073b | htrE | b0139 | htrE | AE000123 | 5447 | 5593 |
| E1M10000119A04 | 41 | EcXA073c | htrE | b0139 | htrE | AE000123 | 5419 | 5642 |
| E1M10000137C03 | 42 | EcXA073d | htrE; ecpD | b0139; b0140 | htrE; ecpD | AE000123 | 5414 | 5919 |
| E1M10000124G03 | 43 | EcXA073e | htrE | b0139 | htrE | AE000123 | 5332 | 5515 |
| P334-8.L7 | 44 | EcXA074 | yciR | b1285 | yciR | AE000226 | 8045 | 8371 |
| 1053-37 | 45 | EcXA074b | yciR | b1285 | yciR | AE000226 | 6079 | 6293 |
| P335-3.J14 | 46 | EcXA075 | SfmD | b0532 | sfmD | AE000159 | 3235 | 3115 |
| P335-8.H8 | 47 | EcXA076 | mviM | b1068 | mviM | AE000207 AE000208 | 11140 50 | 10983 1 |
| P342-3 | 48 | EcXA077 | B2145 | b2145 | yeiS | AE000303 | 9025 | 8831 |
| E1M10000106G10 | 49 | EcXA077b | B2145 | b2145 | yeiS | AE000303 | 9007 | 8841 |
| E1M10000144F3 | 50 | EcXA077c | B2145 | b2145 | yeiS | AE000303 | 9052 | 8827 |
| X3S177-4 | 51 | EcXA078 | ycgB | b1188 | ycgB | AE000217 | 3945 | 4129 |
| P317-2.A3 | 52 | EcXA079 | yedV | b1968 | yedX | AE000288 | 5289 | 5475 |
| E1M10000151C04 | 53 | EcXA079b | yedV | b1968 | yedV | AE000288 | 5179 | 5515 |
| E1M10000162G05 | 54 | EcXA079c | yedV | b1968 | yedV | AE000288 | 5313 | 5503 |
| E1M10000167F04 | 55 | EcXA079d | yedV | b1968 | yedV | AE000288 | 5293 | 5531 |
| E1M10000167G04 | 56 | EcXA079e | yedV | b1968 | yedV | AE000288 | 5293 | 5531 |
| X3S204-7 | 57 | EcXA080 | rplV | b3315 | RplV | AE000408 | 7444 | 7770 |
| E1M10000111C3 | 58 | EcXA080b | RplV; rpsS | b3315; b3316 | RplV; rpsS | AE000408 | 7633 | 7898 |
| E1M10000131B07 | 59 | EcXA080c | RplV; rpsS | b3315; b3316 | RplV; rpsS | AE000408 | 7686 | 7871 |
| E1M10000131C07 | 60 | EcXA080d | RplV; rpsS | b3315; b3316 | RplV; rpsS | AE000408 | 7723 | 7860 |
| E1M10000144G6 | 61 | EcXA080e | rplV | b3315 | RplV | AE000408 | 7580 | 7762 |
| E1M10000144C2 | 62 | EcXA080f | RplV; rpsS | b3315; b3316 | RplV; rpsS | AE000408 | 7650 | 7784 |
| E1M10000107G2 | 63 | EcXA081 | rpsP | b2609 | RpsP | AE000346 | 11957 | 12097 |
| MC9.6 | 64 | EcXA082 | hybC; hybB | b2994; b2995 | HybC; hybB | AE000382 | 4419 | 4562 |
| B18-2.N21 | 65 | EcXA083 | hrpB | b0148 | HrpB | AE000124 | 3024 | 2955 |
| P336-14.F20 | 66 | EcXA084 | B1399 | b1399 | PaaX | AE000237 AE000236 | 164 12073 | 1 12006 |
| 985.P21 | 67 | EcXA085 | AgaZ; agaV | b3132; b3133 | agaZ; agaV | AE000394 | 10111 | 10705 |
| Z92-K24 | 68 | EcXA086 | rplQ | b3294 | RplQ | AE000407 | 7653 | 8349 |
| E1M10000101C12 | 69 | EcXA086b | rplQ | b3294 | RplQ | AE000407 | 7748 | 8075 |
| E1M10000103D11 | 70 | EcXA086c | RplQ | b3294 | RplQ | AE000407 | 7652 | 8051 |
| E1M10000127D09 | 71 | EcXA086d | rplQ; rpoA | b3294; b3295 | RplQ; rpoA | AE000407 | 7806 | 8129 |
| E1M10000152D8 | 72 | EcXA086e | rplQ; rpoA | b3294; b3295 | rplQ; rpoA | AE000407 | 7950 | 8146 |
| SC17.1 | 73 | EcXA087 | YehW | b2128 | YehW | AE000302 | 915 | 1226 |
| SC21.1 | 74 | EcXA088 | RplO | b3301 | RplO | AE000408 | 1743 | 1907 |
| E1M10000107G8 | 75 | EcXA089 | YadT | b0158 | YadT | AE000125 | 4489 | 4639 |
| E1M10000115C6 | 76 | EcXA090 | DnaE | b0184 | DnaE | AE000127 | 10980 | 10830 |
| E1M10000107B2 | 77 | EcXA091 | YkgE | b0306 | YkgE | AE000137 | 9375 | 9261 |
| E1M10000107C3 | 78 | EcXA092 | b1497 | b1497 | YdeM | AE000247 | 689 | 908 |
| E1M10000107H9 | 79 | EcXA093 | YohM | b2106 | YohM | AE000299 | 9423 | 9166 |
| E1M10000109A11 | 80 | EcXA094 | YfjW | b2642 | YfjW | AE000349 | 7160 | 6851 |
| E1M10000160D07 | 81 | EcXA094b | YfjW | b2642 | YfjW | AE000349 | 7118 | 6932 |
| E1M10000161A05 | 82 | EcXA094c | YijW | b2642 | YfjW | AE000349 | 6381 | 5980 |
| E1M10000155A06 | 83 | EcXA094d | YfjW | b2642 | YfjW | AE000349 | 6893 | 6749 |
| E1M10000111A7 | 84 | EcXA095 | b2758 | b2758 | YgcJ | AE000359 | 4983 | 5069 |
| E1M10000107E2 | 85 | EcXA096 | YgcM; ygcN | b2765; b2766 | ygcM; ygcN | AE000360 | 5320 | 5190 |
| E1M10000115E3 | 86 | EcXA097 | yhcB | b3233 | YhcB | AE000402 | 8070 | 7864 |
| E1M10000107B3 | 87 | EcXA097b | yhcB; degQ | b3233; b3234 | yhcB; degQ | AE000402 | 8168 | 7922 |
| E1M10000162F03 | 88 | EcXA097c | yhcB | b3233 | yhcB | AE000402 | 8111 | 7874 |
| E1M10000127H07 | 89 | EcXA097d? | yhcB | b3233 | yhcB | AE000402 | 8092 | 7808 |
| E1M10000163C04 | 90 | EcXA097e | yhcB; degQ? | b3233; b3234 | yhcB; degQ | AE000402 | 8159 | 7874 |
| E1M10000115G2 | 91 | EcXA098 | rpoA | b3295 | RpoA | AE000407 | 8254 | 8453 |
| E1M10000144A8 | 92 | EcXA098b | RplQ; rpoA | b3294; b3295 | RplQ; rpoA | AE000407 | 7841 | 8118 |
| E1M10000101H9 | 93 | EcXA099 | RpsN; rplE | b3307; b3308 | RpsN; RplE | AE000408 | 4403 | 4826 |
| E1M10000111F9 | 94 | EcXA100 | RpmH; rnpA | b3703; b3704 | RpmH; RnpA | AE000447 | 7555 | 7395 |

TABLE I-continued

Identified Clones with Corresponding Genes and Operons

| Clone Name | Seq ID | Molecule No. | Gene (NCBI) | Gene (Blattner) | Gene (Rudd) | Contig | Start | Stop |
|---|---|---|---|---|---|---|---|---|
| E1M10000119D02 | 95 | EcXA100b | rpmH; rnpA | b3703; b3704 | RpmH; RnpA | AE000447 | 7581 | 7395 |
| E1M10000106F05 | 96 | EcXA100c | rpmH; rnpA | b3703; b3704 | RpmH; RnpA | AE000447 | 7594 | 7359 |
| E1M10000152H8 | 97 | EcXA100d | RpmH; rnpA | b3703; b3704 | RpmH; RnpA | AE000447 | 7630 | 7340 |
| E1M10000115H1 | 98 | EcXA101 | yihK | b3871 | TypA | AE000462 | 8811 | 8629 |
| E1M10000101H7 | 99 | EcXA102 | adiY | b4116 | AdiY | AE000484 | 1980 | 2171 |
| E1M10000109A02 | 100 | EcXA103 | yjhB | b4279 | YjhB | AE000498 | 8776 | 8536 |
| E1M10000113A11 | 101 | EcXA104 | hsdS | b4348 | HsdS | AE000505 | 6319 | 6495 |
| E1M10000125A2 | 102 | EcXA104b | hsdS | b4348 | HsdS | AE000505 | 6277 | 6526 |
| E1M10000103A5 | 103 | EcXA105 | ydaU | b1359 | YdaU | AE000233 | 4497 | 4306 |
| E1M10000135B2 | 104 | EcXA106 | ybbV | b0510 | YbbV | AE000157 | 3796 | 3624 |
| E1M10000131G10 | 105 | EcXA106 | ybbV | b0510 | YbbV | AE000157 | 3796 | 3624 |
| E1M10000110A12 | 106 | EcXA107 | yegO | b2076 | YegO | AE000297 | 14471 | 14330 |
| E1M10000110E9 | 107 | EcXA108 | yigK | b3824 | YigK | AE000458 | 3709 | 3964 |
| E1M10000133A06 | 108 | EcXA109 | modC | b0765 | ModC | AE000179 | 2414 | 2180 |
| E1M10000133B08 | 109 | EcXA110 | ynaF; b1377 | b1376; b1377 | YnaF; OmpN | AE000234 | 8011 | 8149 |
| E1M10000106E09 | 110 | EcXA110b | ynaF; b1377 | b1376; b1377 | YnaF; OmpN | AE000234 | 7967 | 8207 |
| E1M10000160G07 | 111 | EcXA110c | ynaF; b1377 | b1376; b1377 | YnaF; OmpN | AE000234 | 7990 | 8114 |
| SC13.1 | 112 | EcXA110d | ynaF | b1376 | YnaF | AE000234 | 8027 | 8243 |
| E1M10000155B05 | 113 | EcXA110e | ynaF; b1377 | b1376; b1377 | YnaF; ompN | AE000234 | 7992 | 8139 |
| E1M10000133D09 | 114 | EcXA111 | ppdA | b2826 | PpdA | AE000366 | 4876 | 5068 |
| E1M10000162B08 | 115 | EcXA111b | ppdA | b2826 | PpdA | AE000366 | 4968 | 5084 |
| E1M10000133E01 | 116 | EcXA112 | yrfF | b3398 | YrfF | AE000415 | 5835 | 5712 |
| E1M10000101A7 | 117 | EcXA113 | ybbQ; ybbv | b0509; b0510 | YbbQ; ybbV | AE000157 | 3753 | 3466 |
| E1M10000131F04 | 118 | EcXA113b | ybbQ; ybbV | b0509; b0510 | YbbQ; ybbv | AE000157 | 3781 | 3536 |
| E1M10000159A09 | 119 | EcXA113c | ybbQ; ybbV | b0509; b0510 | YbbQ; ybbV | AE000157 | 3781 | 3257 |
| E1M10000166F09 | 120 | EcXA113d | ybbV | b0510 | YbbV | AE000157 | 3784 | 3624 |
| E1M10000121E07 | 121 | EcXA114 | b2352; b2353 | b2352; b2353 | YfdH; yfdI | AE000323 | 10110 | 9882 |
| | | | | | | AE000324 | 357 | 1 |
| E1M10000121F06 | 122 | EcXA115 | ygeF | b2850 | YgeF | AE000369 | 570 | 304 |
| E1M10000140B05 | 123 | EcXA115b | ygeF | b2850 | YgeF | AE000369 | 512 | 312 |
| E1M10000148H09 | 124 | EcXA115c | ygeF | b2850 | YgeF | AE000369 | 607 | 361 |
| E1M10000164A02 | 125 | EcXA115d | ygeF | b2850 | YgeF | AE000369 | 555 | 411 |
| E1M10000121G05 | 126 | EcXA116 | insB_3 | b0021 | | AE000135 | 5258 | 5726 |
| E1M10000136D3 | 127 | EcXA117 | rhsA | b3593 | RhsA | AE000437 | 4125 | 3529 |

Example 4

Identification of Genes and their Corresponding Operons Affected by Antisense Inhibition The sequencing of the entire *E. coli* genome is described in Blattner et al., Science 277:1453–1474(1997) the entirety of which is hereby incorporated by reference and the sequence of the genome is listed in GenBank Accession No. U00096, the disclosure of which is incorporated herein by reference in its entirety. The operons to which the proliferation-inhibiting nucleic acids correspond were identified using RegulonDB and information in the literature. The coordinates of the boundaries of these operons on the *E. coli* genome are listed in Table III. Table II lists the molecule numbers of the inserts containing the growth inhibiting nucleic acid fragments, the genes in the operons corresponding to the inserts, the SEQ ID NOs of the genes containing the inserts, the SEQ ID NOs of the proteins encoded by the genes, the start and stop points of the genes on the *E. coli* genome, the orientation of the genes on the genome, whether the operons are predicted or documented, and the predicted functions of the genes. The identified operons, their putative functions, and whether or not the genes are presently thought to be required for proliferation are discussed below.

Functions for the identified genes were determined by using either Blattner functional class designations or by comparing identified sequence with known sequences in various databases. A variety of biological functions were noted for the genes to which the clones of the present invention correspond. The functions for the genes of interest appear in Table II.

The proteins that are listed in Table II are involved in a wide range of biological functions.

TABLE II

All Operon Data with Whole Chromosome Coordinates

| Molecule Number | Gene | Seq ID No. (gene) | Seq ID No. (protein) | Start | Stop | Operon | Blattner Functional Class | Predicted Function |
|---|---|---|---|---|---|---|---|---|
| EcXA056 | ycfS | 128 | 299 | 1168635 | 1169597 | predicted operon | hypothetical, unclassified, unknown | |
| EcXA057 | arp | 129 | 300 | 4217880 | 4220066 | predicted operon | Fatty acid and phospholipid metabolism | ankyrin repeat protein |
| EcXA058 | rpsQ | 130 | 301 | 3445951 | 3446205 | documented | Translation, post-translational modification | |
| | rpmC | 131 | 302 | 3446205 | 3446396 | | Translation, post-translational modification | |
| | rplP | 132 | 303 | 3446396 | 3446806 | | Translation, post-translational modification | |
| | rpsC | 133 | 304 | 3446819 | 3447520 | | Translation, post-translational modification | |
| | rplV | 134 | 305 | 3447538 | 3447870 | | Translation, post-translational modification | |
| | rpsS | 135 | 306 | 3447885 | 3448163 | | Translation, post-translational modification | |
| | rplB | 136 | 307 | 3448180 | 3449001 | | Translation, post-translational modification | translation |
| | rplW | 137 | 308 | 3449019 | 3449321 | | Translation, post-translational modification | translation |
| | rplD | 138 | 309 | 3449318 | 3449923 | | Translation, post-translational modification | |
| | rplC | 139 | 310 | 3449934 | 3450563 | | Translation, post-translational modification | |
| | rpsJ | 140 | 311 | 3450596 | 3450907 | | Translation, post-translational modification | |
| EcXA059 | ypjA | 141 | 312 | 2776167 | 2780876 | predicted operon | Translation, post-translational modification | |
| EcXA060 | rpmJ | 142 | 313 | 3440255 | 3440371 | documented | Translation, post-translational modification | |
| | prlA | 143 | 314 | 3440403 | 3441734 | | Putative transport proteins | |
| | rplO | 144 | 315 | 3441742 | 3442176 | | Translation, post-translational modification | |
| | rpmD | 145 | 316 | 3442180 | 3442359 | | Translation, post-translational modification | |
| | rpsE | 146 | 317 | 3442363 | 3442866 | | Translation, post-translational modification | |
| | rplR | 147 | 318 | 3442881 | 3443234 | | Translation, post-translational modification | |
| | rplF | 148 | 319 | 3443244 | 3443777 | | Translation, post-translational modification | translation |
| | rpsH | 149 | 320 | 3443790 | 3444182 | | Translation, post-translational modification | |
| | rpsN | 150 | 321 | 3444216 | 3444521 | | Translation, post-translational modification | |
| | rplE | 151 | 322 | 3444536 | 3445075 | | Translation, post-translational modification | translation |
| | rplX | 152 | 323 | 3445090 | 3445404 | | Translation, post-translational modification | |
| | rplN | 153 | 324 | 3445415 | 3445786 | | Translation, post-translational modification | |
| EcXA061 | malE | 154 | 325 | 4242808 | 4243998 | documented | Transport and binding proteins | |
| | malF | 155 | 326 | 4241110 | 4242654 | | Transport and binding proteins | |
| | malG | 156 | 327 | 4240205 | 4241095 | | Transport and binding proteins | |
| EcXA062 | rep | 157 | 328 | 3958292 | 3960313 | predicted operon | DNA replication, recombination, modification and repair | |
| EcXA063 | b2269 | 158 | 329 | 2380733 | 2381944 | predicted operon | Putative enzymes | putative phosphatase/sulfatase |
| EcXA064 | cyoE | 159 | 330 | 446039 | 446929 | documented | Energy metabolism | |
| | cyoA | 160 | 331 | 449887 | 450834 | | Energy metabolism | |
| | cyoB | 161 | 332 | 447874 | 449865 | | Energy metabolism | |
| | cyoC | 162 | 333 | 447270 | 447884 | | Energy metabolism | |
| | cyoD | 163 | 334 | 446941 | 447270 | | Energy metabolism | |
| EcXA065 | dgoA | 164 | 335 | 3869477 | 3871240 | predicted | Carbon compound catabolism | 2-Oxo-3-deoxygalactonate 6-phosphate aldolase |
| | dgoK | 165 | 336 | 3871224 | 3872401 | | Carbon compound catabolism | |

TABLE II-continued

All Operon Data with Whole Chromosome Coordinates

| Molecule Number | Gene | Seq ID No. (gene) | Seq ID No. (protein) | Start | Stop | Operon | Blattner Functional Class | Predicted Function |
|---|---|---|---|---|---|---|---|---|
| | yidw | 166 | 337 | 3872401 | 3872787 | | Hypothetical, unclassified, unknown | |
| | b3694 | 167 | 338 | 3872099 | 3872395 | | Putative regulatory protein | |
| EcXA966 | rplT | 168 | 339 | 1797417 | 1797773 | documented | Translation, post-translational modification | |
| | rpmI | 169 | 340 | 1797826 | 1798023 | | Translation, post-translational modification | |
| | infC | 170 | 341 | 1798120 | 1798662 | | Translation, post-translational modification | translation |
| | thrS | 171 | 342 | 1798666 | 1800594 | | Translation, post-translational modification | |
| EcXA067 | xylF | 172 | 343 | 3728760 | 3729752 | | Transport and binding proteins | |
| EcXA068 | yhfL | 173 | 344 | 3497085 | 3497252 | predicted operon | Hypothetical, unclassified, unknown | |
| | yhfM | 174 | 345 | 3497496 | 3498884 | predicted operon | Putative Transport | |
| | yhfN | 175 | 346 | 3498884 | 3499927 | | Putative Transport | |
| | yhfO | 176 | 347 | 3499890 | 3500339 | | Hypothetical, unclassified, unknown | |
| EcXA069 | | x | x | | | same operon as EcXA058 | | |
| EcXA070 | ybcQ | 177 | 348 | 573179 | 573562 | predicted operon | Hypothetical, unclassified, unknown | |
| EcXA071 | ffh | 178 | 349 | 2744454 | 2745815 | predicted operon | Transport and binding proteins | |
| EcXA072 | recJ | 179 | 350 | 3034393 | 3036126 | predicted operon | Transcription, RNA processing and degradation | |
| | dsbC | 180 | 351 | 3036132 | 3036842 | | Cell structure | |
| | xerD | 181 | 352 | 3036867 | 3037763 | | DNA replication, recombination, modification and repair | |
| EcXA073 | ecpD | 182 | 353 | 155461 | 156201 | documented | Cell structure | |
| | htrE | 183 | 354 | 152829 | 155426 | | Cell structure | |
| EcXA074 | yciR | 184 | 355 | 1342781 | 1344766 | predicted operon | Hypothetical, unclassified, unknown | |
| EcXA075 | sfmC | 185 | 356 | 558197 | 558889 | predicted operon | Putative chaperonin | |
| | sfmD | 186 | 357 | 558920 | 561523 | | Cell structure | |
| | sfmH | 187 | 358 | 561565 | 562542 | | Cell processes (incl. adaptation, protection) | |
| | sfmF | 188 | 359 | 562553 | 563068 | | Cell processes (incl. adaptation, protection) | |
| EcXA076 | rimJ | 189 | 360 | 1124785 | 1125369 | predicted operon | Translation, post-translational modification | |
| | yceH | 190 | 361 | 1125380 | 1126027 | | Hypothetical, unclassified, unknown | |
| | mviM | 191 | 362 | 1126029 | 1126952 | | Cell processes (incl. adaptation, protection) | |
| EcXA077 | sanA | 192 | 363 | 2230898 | 2231617 | predicted | | |
| | b2145 | 193 | 364 | 2231620 | 2231859 | | Hypothetical, unclassified, unknown | |
| EcXA078 | ycgB | 194 | 365 | 1234932 | 1236464 | predicted operon | Hypothetical, unclassified, unknown | |
| EcXA079 | yedV | 195 | 366 | 2034816 | 2036174 | predicted | Hypothetical, unclassified, unknown | |
| | yedW | 196 | 367 | 2036174 | 2036893 | | Hypothetical, unclassified, unknown | |
| EcXA080 | | x | x | | | same operon as EcXA058 | | |
| EcXA081 | b2107 | 197 | 368 | 2184800 | 2185318 | predicted | Hypothetical, unclassified, unknown | |
| | b2106 | 198 | 369 | 2183937 | 2184761 | | Hypothetical, unclassified, unknown | |
| EcXA082 | hybG | 199 | 370 | 3137731 | 3137979 | documented | Energy metabolism | |
| | hybF | 200 | 371 | 3137992 | 3138333 | | Energy metabolism | |
| | hybE | 201 | 372 | 3138326 | 3138814 | | Energy metabolism | |
| | hybD | 202 | 373 | 3138807 | 3139301 | | Energy metabolism | |
| | hybC | 203 | 374 | 3139301 | 3141004 | | Energy metabolism | |
| | hybB | 204 | 375 | 3141001 | 3142179 | | Energy metabolism | |
| | hybA | 205 | 376 | 3142169 | 3143155 | | Energy metabolism | |

TABLE II-continued

All Operon Data with Whole Chromosome Coordinates

| Molecule Number | Gene | Seq ID No. (gene) | Seq ID No. (protein) | Start | Stop | Operon | Blattner Functional Class | Predicted Function |
|---|---|---|---|---|---|---|---|---|
| EcXA083 | hrpB | 206 | 377 | 162060 | 164534 | | Transcription, RNA processing and degradation | |
| EcXA084 | b1399 | 207 | 378 | 1461563 | 1462513 | | Hypothetical, unclassified, unknown | |
| | b1400 | 208 | 379 | 1462495 | 1463085 | | Hypothetical, unclassified, unknown | |
| EcXA085 | agaZ | 209 | 380 | 3276555 | 3277835 | predicted | Carbon compound catabolism | putative tagatose 6-phosphate kinase 2 |
| | agaV | 210 | 381 | 3277822 | 3278331 | | Central intermediary metabolism | PTS system, (EIIB-AGA) |
| | agaW | 211 | 382 | 3278342 | 3278743 | | Central intermediary metabolism | PTS system (EIIC) |
| | agaA | 212 | 383 | 3278763 | 3279266 | | Central intermediary metabolism | putative N-NAG-6-phosphatedeacetylase |
| | agaS | 213 | 384 | 3279617 | 3280771 | | Central intermediary metabolism | putative tagatose-6-phosphate aldose/ketose isomerase |
| | agaY | 214 | 385 | 3280784 | 3281644 | | Central intermediary metabolism | tagatose-bisphosphate aldolase 2 |
| EcXA086 | rpsM | 215 | 386 | 3439752 | 3440108 | documented | Translation, post-translational modification | |
| | rpsK | 216 | 387 | 3439346 | 3439735 | | Translation, post-translational modification | |
| | rpsD | 217 | 388 | 3438692 | 3439312 | | Translation, post-translational modification | |
| | rpoA | 218 | 389 | 3437677 | 3438666 | | Translation, post-translational modification | |
| | rplQ | 219 | 390 | 3437253 | 3437636 | | Translation, post-translational modification | |
| EcXA087 | yehW | 220 | 391 | 2213765 | 2214496 | predicted | Hypothetical, unclassified, unknown | |
| | yehX | 221 | 392 | 2214501 | 2215427 | | Hypothetical, unclassified, unknown | |
| | yehY | 222 | 393 | 2215420 | 2216577 | | Hypothetical, unclassified, unknown | |
| | yehZ | 223 | 394 | 2216584 | 2217501 | | Hypothetical, unclassified, unknown | |
| EcXA088 | | x | x | | | same as EcXA060 | | |
| EcXA089 | yadS | 224 | 395 | 177662 | 178462 | predicted operon | Hypothetical, unclassified, unknown | |
| | yadT | 225 | 396 | 177662 | 178462 | | Hypothetical, unclassified, unknown | |
| | pfs | 226 | 397 | 178455 | 179153 | | | |
| EcXA090 | lpxA | 227 | 398 | 202560 | 203348 | predicted operon | | |
| | lpxB | 228 | 399 | 203348 | 204496 | | | |
| | mhB | 229 | 400 | 204493 | 205089 | | | RnaaseH 2 |
| | dnaE | 230 | 401 | 205126 | 208608 | | | DNA pol III subunit |
| EcXA091 | ykgE | 231 | 402 | 320832 | 321551 | predicted | Hypothetical, unclassified, unknown | |
| | ykgF | 232 | 403 | 321562 | 322989 | | Hypothetical, unclassified, unknown | |
| | ykgG | 233 | 404 | 322829 | 323677 | | Hypothetical, unclassified, unknown | |
| EcXA092 | b1497 | 234 | 405 | 1577657 | 1578829 | predicted | Hypothetical, unclassified, unknown | |
| | b1498 | 235 | 406 | 1578866 | 1580581 | | Hypothetical, unclassified, unknown | |
| EcXA093 | yohM | 236 | 407 | 2183937 | 2184761 | predicted | Hypothetical, unclassified, unknown | |
| | b2107 | 237 | 408 | 2184800 | 2185318 | | Hypothetical, unclassified, unknown | |
| EcXA094 | yfjW | 238 | 409 | 2771339 | 2773042 | predicted | Hypothetical, unclassified, unknown | |
| EcXA095 | b2758 | 239 | 410 | 2879074 | 2880165 | predicted | Hypothetical, unclassified, unknown | |
| EcXA096 | ygcM | 240 | 411 | 2890237 | 2890602 | predicted | Hypothetical, unclassified, unknown | |
| | ygcN | 241 | 412 | 2890650 | 2891951 | | Hypothetical, unclassified, unknown | |

TABLE II-continued

All Operon Data with Whole Chromosome Coordinates

| Molecule Number | Gene | Seq ID No. (gene) | Seq ID No. (protein) | Start | Stop | Operon | Blattner Functional Class | Predicted Function |
|---|---|---|---|---|---|---|---|---|
| | b2767 | 242 | 413 | 2891906 | 2892202 | | Hypothetical, unclassified, unknown | |
| | b2768 | 243 | 414 | 2892219 | 2892794 | | Hypothetical, unclassified, unknown | |
| EcXA097 | yhcB | 244 | 415 | 3377820 | 3378224 | predicted operon | Hypothetical, unclassified, unknown | |
| | hhoA (degQ) | 245 | 416 | 3378378 | 3379745 | predicted operon | Translation, post-translational modification | |
| | hhoB | 246 | 417 | 3379835 | 3380902 | | Translation, post-translational modification | |
| EcXA098 | rpsM | 247 | 418 | 3439752 | 3440108 | documented | Translation, post-translational modification | |
| | rpsK | 248 | 419 | 3439346 | 3439735 | | Translation, post-translational modification | |
| | rpsD | 249 | 420 | 3438692 | 3439312 | | Translation, post-translational modification | |
| | rpoA | 250 | 421 | 3437677 | 3438666 | | Translation, post-translational modification | |
| | rplQ | 251 | 422 | 3437253 | 3437636 | | Translation, post-translational modification | |
| EcXA099 | | x | x | | | same as EcXA060 | | |
| EcXA100 | rpmH | 252 | 423 | 3881965 | 3882105 | documented | Translation, post-translational modification | |
| | mpA | 253 | 424 | 3882122 | 3882481 | | DNA replication, recombination, modification and repair | |
| EcXA101 | yjhK | 254 | 425 | 4055987 | 4057762 | predicted operon | Hypothetical, unclassified, unknown | |
| EcXA102 | adi | 255 | 426 | 4335832 | 4338102 | documented | Putative regulatory proteins | biodegradative acid-induced arginine decarboxylase |
| | adiY | 256 | 427 | 4334746 | 4335507 | | Amino acid biosynthesis and metabolism | |
| EcXA103 | yjhB | 257 | 428 | 4501566 | 4502843 | predicted operon | Hypothetical, unclassified, unknown | |
| | yjhC | 258 | 429 | 4502840 | 4503973 | | Hypothetical, unclassified, unknown | |
| EcXA104 | hsdS | 259 | 430 | 4577638 | 4579032 | documented | DNA replication, recombination, modification and repair | host specificity |
| | hsdM | 260 | 431 | 4579029 | 4580618 | | DNA replication, recombination, modification and repair | |
| EcXA105 | b1357 | 261 | 432 | 1418389 | 1418685 | predicted | Hypothetical, unclassified, unknown | |
| | b1358 | 262 | 433 | 1418708 | 1419130 | | Hypothetical, unclassified, unknown | |
| | ydaU | 263 | 434 | 1419143 | 1420000 | | Hypothetical, unclassified, unknown | |
| | b1360 | 264 | 435 | 1420007 | 1420753 | | Hypothetical, unclassified, unknown | |
| | b1361 | 265 | 436 | 1420725 | 1421336 | | Hypothetical, unclassified, unknown | |
| | b1362 | 266 | 437 | 1421363 | 1421668 | | Hypothetical, unclassified, unknown | |
| EcXA106 | ybbQ | 267 | 438 | 535810 | 536688 | predicted | Hypothetical, unclassified, unknown | |
| | ybbV | 268 | 439 | 536720 | 536998 | | Hypothetical, unclassified, unknown | |
| | b0511 | 269 | 440 | 536998 | 538311 | | Hypothetical, unclassified, unknown | |
| EcXA107 | yegM | 270 | 441 | 2151891 | 2153285 | predicted | Hypothetical, unclassified, unknown | |
| | yegN | 271 | 442 | 2153285 | 2156407 | | Hypothetical, unclassified, unknown | |
| | yegO | 272 | 443 | 2156408 | 2159485 | | Hypothetical, unclassified, unknown | |
| | yegB | 273 | 444 | 2159486 | 2160901 | | Hypothetical, unclassified, unknown | |
| EcXA108 | yigK | 274 | 445 | 4006046 | 4006462 | | Hypothetical, unclassified, unknown | |

TABLE II-continued

All Operon Data with Whole Chromosome Coordinates

| Molecule Number | Gene | Seq ID No. (gene) | Seq ID No. (protein) | Start | Stop | Operon | Blattner Functional Class | Predicted Function |
|---|---|---|---|---|---|---|---|---|
| EcXA109 | modA | 275 | 446 | 794312 | 795085 | documented | Transport and binding proteins | molybdate uptake |
|  | modB | 276 | 447 | 795085 | 795774 |  | Transport and binding proteins |  |
|  | modC | 277 | 448 | 795777 | 796835 |  | Transport and binding proteins |  |
| EcXA110 | ynaF | 278 | 449 | 1433209 | 1433715 | predicted | Hypothetical, unclassified, unknown |  |
|  | b1377 | 279 | 450 | 1433784 | 1434917 | predicted | Hypothetical, unclassified, unknown |  |
| EcXA111 | recC | 280 | 451 | 2957082 | 2960450 | predicted | Transcription, RNA processing and degradation |  |
|  | ppdC | 281 | 452 | 2960463 | 2960786 |  | Other known genes | prepilin peptidase dependent protein C |
|  | ygdB | 282 | 453 | 2960771 | 2961136 |  | Hypothetical, unclassified, unknown |  |
|  | ppdB | 283 | 454 | 2961175 | 2961738 |  | Other known genes | prepilin peptidase dependent protein B |
|  | ppdA | 284 | 455 | 2961729 | 2962199 |  | Other known genes | prepilin peptidase dependent protein A |
| EcXA112 | yrfF | 285 | 456 | 3524107 | 3526242 | predicted | Hypothetical, unclassified, unknown |  |
|  | yrfG | 286 | 457 | 3526262 | 3526975 |  | Hypothetical, unclassified, unknown |  |
|  | yrfH | 287 | 458 | 3526986 | 3527387 |  | Hypothetical, unclassified, unknown |  |
|  | yrfI | 288 | 459 | 3527406 | 3528290 |  | Hypothetical, unclassified, unknown |  |
| EcXA113 |  | x | x |  |  | same as EcXA106 |  |  |
| EcXA114 | b2350 | 289 | 460 | 2465875 | 2466237 | predicted | Hypothetical, unclassified, unknown |  |
|  | b2351 | 290 | 461 | 2466234 | 2467154 |  | Hypothetical, unclassified, unknown |  |
|  | b2352 | 291 | 462 | 2467151 | 2468482 |  | Hypothetical, unclassified, unknown |  |
|  | b2353 | 292 | 463 | 2468781 | 2469125 | predicted | Hypothetical, unclassified, unknown |  |
| EcXA115 | ygeF | 293 | 464 | 2988576 | 2989022 | predicted | Hypothetical, unclassified, unknown |  |
| EcXA116 | insB_3 | 294 | 465 | 289873 | 290376 | predicted | phage, transposon, or plasmid |  |
|  | insA_3 | 295 | 466 | 290295 | 290570 |  | phage, transposon, or plasmid |  |
| EcXA117 | rhsA | 296 | 467 | 3759810 | 3763943 | predicted | Hypothetical, unclassified, unknown |  |
|  | yibA | 297 | 468 | 3763964 | 3763806 |  | Hypothetical unclassified, unknown |  |
|  | yibJ | 298 | 469 | 3764848 | 3765549 |  | Hypothetical, unclassified, unknown |  |

Functions for the identified genes were determined by using either Blattner functional class designations or by comparing identified sequence with known sequences in various databases. A variety of biological functions were noted for the genes to which the clones of the present invention correspond. Biological functions for genes that lie on the same operon as an identified gene have also been made. The functions for the genes of interest appear in Table II.

The genes of interest have a variety of biological functions. For example, genes that are thought to function as transport or binding proteins, that participate in translation or post-translational modification, that are involved in carbon compound catabolism, that are thought to be enzymes, participate in cell processes, energy metabolism and biosynthetic functions appear in Table II. Genes that are involved in cell structure, transcription, RNA processing and degradation also appear in Table II.

Several of the expression vectors contain fragments that correspond to genes of unknown function or if the function is known, it is not known whether the gene is essential. For example, EcXA056, 057, 059, 063, 064, 065, 067, 068, 070, 073, 074, 075, 076, 077, 078, 079, 081, 084, 085, 087, 089, 091, 092, 093, 094, 095, 096, 097, 101, 102, 103, 105, 106, 107, 108, 109, 110, 111, 112, 113, 114, 115 and 117 are all exogenous nucleic acid sequences that correspond to E. coli proteins that have no known function or where the function has not been shown to be essential or nonessential.

The present invention reports a number of novel E. coli genes and operons that are required for proliferation. From the list of clone sequences identified here, each was identified to be a portion of a gene in an operon required for the proliferation of *E. coli*. Cloned sequences corresponding to genes already known to be required for proliferation in *E. coli* include EcXA058, 060, 066, 069, 071, 080, 086, 088, 090, 098, 099 and 100 are exogenous nucleic acid sequences that correspond to *E. coli* genes that are known to be required for cellular proliferation. The remaining identified sequences correspond to *E. coli* genes previously undesignated as required for proliferation in the art.

An interesting observation of the present invention is that there are also several sequence fragments that correspond to *E. coli* genes that are not thought to be required for *E. coli* proliferation. Nevertheless, under the conditions described above, the antisense expression of these gene fragments causes a reduction in cell growth. This result implies that the genes corresponding to the identified sequences are actually required for proliferation or are in operons required for proliferation. Molecule Nos. corresponding to these genes are EcXA061, 062, 072, 082, 083, 104 and 116.

Following identification of the sequences of interest, these sequences were localized into operons. Since bacterial genes are expressed in a polycistronic manner, the antisense inhibition of a single gene in an operon might effect the expression of all the other genes on the operon or the genes down stream from the single gene identified. In order to determine which of the gene products in an operon are required for proliferation, each of the genes contained within an operon may be analyzed for their effect on viability as described below.

TABLE III

Operon Boundaries

| Molecule Number | Start | Stop |
|---|---|---|
| EcXA056 | 1168635 | 1169597 |
| EcXA057 | 4217880 | 4220066 |
| EcXA059 | 2776167 | 2780876 |
| EcXA061 | 4240205 | 4243998 |
| EcXA062 | 3958292 | 3960313 |
| EcXA063 | 2380733 | 2381944 |
| EcXA064 | 446039 | 450834 |
| EcXA065 | 3869477 | 3872395 |
| EcXA067 | 3728760 | 3729752 |
| EcXA068 | 3497085 | 3500339 |
| EcXA070 | 573179 | 573562 |
| EcXA071 | 2744454 | 2745815 |
| EcXA072 | 3034393 | 3037763 |
| EcXA073 | 152829 | 156201 |
| EcXA074 | 1342781 | 1344766 |
| EcXA075 | 558197 | 563068 |
| EcXA076 | 1124785 | 1126952 |
| EcXA077 | 2230898 | 2231859 |
| EcXA078 | 1234932 | 1236464 |
| EcXA079 | 2034816 | 2036893 |
| EcXA081 | 2183937 | 2185318 |
| EcXA082 | 3137731 | 3143155 |
| EcXA083 | 162060 | 164534 |
| EcXA084 | 1461563 | 1463085 |
| EcXA085 | 3276555 | 3280771 |
| EcXA086 | 3437253 | 3440108 |
| EcXA087 | 2213765 | 2217501 |
| EcXA089 | 177662 | 179153 |
| EcXA090 | 202560 | 208608 |
| EcXA091 | 320832 | 323677 |
| EcXA092 | 1577657 | 1580581 |
| EcXA093 | 2183937 | 2185318 |
| EcXA094 | 2771339 | 2773042 |
| EcXA095 | 2879074 | 2880165 |
| EcXA096 | 2890237 | 2892794 |
| EcXA097 | 3377820 | 3380902 |
| EcXA098 | 3437253 | 3438666 |
| EcXA100 | 3881965 | 3882481 |

TABLE III-continued

Operon Boundaries

| Molecule Number | Start | Stop |
|---|---|---|
| EcXA101 | 4055987 | 4057762 |
| EcXA102 | 4334746 | 4338102 |
| EcXA103 | 4501566 | 4503973 |
| EcXA104 | 4577638 | 4580618 |
| EcXA105 | 1418389 | 1421668 |
| EcXA106 | 535810 | 538311 |
| EcXA107 | 2151891 | 2160901 |
| EcXA108 | 4006046 | 4006462 |
| EcXA109 | 794312 | 796835 |
| EcXA110 | 1433209 | 1434917 |
| EcXA111 | 2957082 | 2962199 |
| EcXA112 | 3524107 | 3528290 |
| EcXA114 | 2465875 | 2469125 |
| EcXA115 | 2988576 | 2989022 |
| EcXA116 | 289873 | 290570 |
| EcXA117 | 3759810 | 3765549 |

Example 5

Identification of Individual Genes within an Operon Required for Proliferation

The following example illustrates a method for determining which gene in an operon is required for proliferation. The clone insert corresponding to Molecule No. EcXA066 possesses nucleic acid sequence homology to the *E. coli* genes rplT and rpml These genes are located in an operon containing two additional genes, infC and thrS. To determine which gene or genes in this operon are required for proliferation, each gene is selectively inactivated using homologous recombination. Gene rplT is the first gene to be inactivated.

Deletion inactivation of a chromosomal copy of a gene in *E. coli* can be accomplished by integrative gene replacement. The principle of this method (Hamilton, C. M., et al 1989. *J. Bacteriol.* 171: 4617–4622) is to construct a mutant allele of the targeted gene, introduce that allele into the chromosome using a conditional suicide vector, and then force the removal of the native wild type allele and vector sequences. This will replace the native gene with a desired mutation(s) but leave promoters, operators, etc. intact. Essentiality of a gene is determined either by deduction from genetic analysis or by conditional expression of a wild type copy of the targeted gene (trans complementation).

The first step is to generate a mutant rplT allele using PCR amplification. Two sets of PCR primers are chosen to produce a copy of rplT with a large central deletion to inactivate the gene. In order to eliminate polar effects, it is desirable to construct a mutant allele comprising an in-frame deletion of most or all of the coding region of the rplT gene. Each set of PCR primers is chosen such that a region flanking the gene to be amplified is sufficiently long to allow recombination (typically at least 500 nucleotides on each side of the deletion). The targeted deletion or mutation will be contained within this fragment. To facilitate cloning of the PCR product, the PCR primers may also contain restriction endonuclease sites found in the cloning region of a conditional knockout vector such as pKO3 (Link, et al 1997 *J Bacteriol.* 179 (20): 6228–6237). Suitable sites include NotI, SalI, BamHI and SmaI. The rplT gene fragments are produced using standard PCR conditions including, but not limited to, those outlined in the manufacturers directions for the Hot Start Taq PCR kit (Qiagen, Inc., Valencia, Calif.).

The PCR reactions will produce two fragments that can be fused together. Alternatively, crossover PCR can be used to generate a desired deletion in one step (Ho, S. N., et al 1989. Gene 77: 51–59, Horton, R. M., et al 1989. Gene 77: 61–68). The mutant allele thus produced is called a "null" allele because it cannot produce a functional gene product.

The mutant allele obtained from PCR amplification is cloned into the multiple cloning site of pKO3. Directional cloning of the rplT null allele is not necessary. The pKO3 vector has a temperature-sensitive origin of replication derived from pSC101. Therefore, clones are propagated at the permissive temperature of 30° C. The vector also contains two selectable marker genes: one that confers resistance to chloramphenicol and another, the Bacillus subtilis sacB gene, that allows for counter-selection on sucrose containing growth medium. Clones that contain vector DNA with the null allele inserted are confirmed by restriction endonuclease analysis and DNA sequence analysis of isolated plasmid DNA. The plasmid containing the rplT null allele insert is known as a knockout plasmid.

Once the knockout plasmid has been constructed and its sequence verified, it is transformed into a Rec+ E. coli host cell. Transformation can be by any standard method such as electroporation. In some fraction of the transformed cells, plasmids will integrate into the E. coli chromosome by homologous recombination between the rplT null allele in the plasmid and the rplT gene in the chromosome. Transformant colonies in which such an event has occurred are readily selected by growth at the non-permissive temperature of 43° C. and in the presence of choramphenicol. At this temperature, the plasmid will not replicate as an episome and will be lost from cells as they grow and divide. These cells are no longer resistant to chloramphenicol and will not grow when it is present. However, cells in which the knockout plasmid has integrated into the E. coli chromosome remain resistant to chloramphenicol and propagate.

Cells containing integrated knock-out plasmids are usually the result of a single crossover event that creates a tandem repeat of the mutant and native wild type alleles of rplT separated by the vector sequences. A consequence of this is that rplT will still be expressed in these cells. In order to determine if the gene is essential for growth, the wild type copy must be removed. This is accomplished by selecting for plasmid excision, a process in which homologous recombination between the two alleles results in looping out of the plasmid sequences. Cells that have undergone such an excision event and have lost plasmid sequences including sacB gene are selected for by addition of sucrose to the medium. The sacB gene product converts sucrose to a toxic molecule. Thus counter selection with sucrose ensures that plasmid sequences are no longer present in the cell. Loss of plasmid sequences is further confirmed by testing for sensitivity to chloramphenicol (loss of the chloramphenicol resistance gene). The latter test is important because occasionally a mutation in the sacB gene can occur resulting in a loss of sacB function with no effect on plasmid replication (Link, et. al., 1997 J. Bacteriol. 179 (20): 6228–6237). These artifact clones retain plasmid sequences and are therefore still resistant to chloramphenicol.

In the process of plasmid excision, one of the two rplT alleles is lost from the chromosome along with the plasmid DNA. In general, it is equally likely that the null allele or the wild type allele will be lost. Therefore, if the rplT gene is not essential, half of the clones obtained in this experiment will have the wild type allele on the chromosome and half will have the null allele. However, if the rplT gene is essential, cells containing the null allele will not be obtained as a single copy of the null allele would be lethal.

To determine the essentiality of rplT, a statistically significant number of the resulting clones, at least 20, are analyzed by PCR amplification of the rplT gene. Since the null allele is missing a significant portion of the rplT gene, its PCR product is significantly shorter than that of the wild type gene and the two are readily distinguished by gel electrophoretic analysis. The PCR products may also be subjected to sequence determination for further confirmation by methods well known to those in the art.

The above experiment is generally adequate for determining the essentiality of a gene such as rplT. However, it may be necessary or desirable to more directly confirm the essentiality of the gene. There are several methods by which this can be accomplished. In general, these involve three steps: 1) construction of an episome containing a wild type allele, 2) isolation of clones containing a single chromosomal copy of the mutant null allele as described above but in the presence of the episomal wild type allele, and then 3) determining if the cells survive when the expression of the episomal allele is shut off. In this case, the trans copy of wild type rplT is made by PCR cloning of the entire coding region of rplT and inserting it in the sense orientation downstream of an inducible promoter such as the E. coli lac promoter. Transcription of this allele of rplT will be induced in the presence of IPTG which inactivates the lac repressor. Under IPTG induction rplT protein will be expressed as long as the recombinant gene also possesses a ribosomal binding site, also known as a "Shine-Dalgarno Sequence". The trans copy of rplT is cloned on a plasmid that is compatible with pSC101. Compatible vectors include p15A, pBR322, and the pUC plasmids, among others. Replication of the compatible plasmid will not be temperature-sensitive. The entire process of integrating the null allele of rplT and subsequent plasmid excision is carried out in the presence of IPTG to ensure the expression of functional rplT protein is maintained throughout. After the null rplT allele is confirmed as integrated on the chromosome in place of the wild type rplT allele, then IPTG is withdrawn and expression of functional rplT protein shut off. If the rplT gene is essential, cells will cease to proliferate under these conditions. However, if the rplT gene is not essential, cells will continue to proliferate under these conditions. In this experiment, essentiality is determined by conditional expression of a wild type copy of the gene rather than inability to obtain the intended chromosomal disruption.

An advantage of this method over some other gene disruption techniques is that the targeted gene can be deleted or mutated without the introduction of large segments of foreign DNA. Therefore, polar effects on downstream genes are eliminated or minimized. There are methods described to introduce inducible promoters upstream of potential essential bacterial genes. However in such cases, polarity from multiple transcription start points can be a problem. One way of preventing this is to insert a gene disruption cassette that contains strong transcriptional terminators upstream of the integrated inducible promoter (Zhang, Y, and Cronan, J. E. 1996 J. Bacteriol. 178 (12): 3614–3620). The described techniques will all be familiar to one of ordinary skill in the art.

Following the analysis of the rplT gene, the other genes of the operon are investigated to determine if they are required for proliferation.

Example 6

Expression of the Proteins Encoded by Genes Identified as Required for E. coli Proliferation The following is provided as one exemplary method to express the proliferation-required proteins encoded by the identified sequences described above. First, the initiation and termination codons for the gene are identified. If desired, methods for improving translation or expression of the protein are well known in the art. For example, if the nucleic acid encoding the polypeptide to be expressed lacks a methionine codon to serve as the initiation site, a strong Shine-Delgarno sequence, or a stop codon, these sequences can be added. Similarly, if the identified nucleic acid sequence lacks a transcription termination signal, this sequence can be added to the construct by, for example, splicing out such a sequence from an appropriate donor sequence. In addition, the coding sequence may be operably linked to a strong promoter or an inducible promoter if desired. The identified nucleic acid sequence or portion thereof encoding the polypeptide to be expressed is obtained by PCR from the bacterial expression vector or genome using oligonucleotide primers complementary to the identified nucleic acid sequence or portion thereof and containing restriction endonuclease sequences for NcoI incorporated into the 5' primer and BglII at the 5' end of the corresponding 3'-primer, taking care to ensure that the identified nucleic acid sequence is positioned in frame with the termination signal. The purified fragment obtained from the resulting PCR reaction is digested with NcoI and BglII, purified and ligated to an expression vector.

The ligated product is transformed into DH5α or some other E. coli strain suitable for the over expression of potential proteins. Transformation protocols are well known in the art. For example, transformation protocols are described in: Current Protocols in Molecular Biology, Vol. 1, Unit 1.8, (Ausubel, et al., Eds.) John Wiley & Sons, Inc. (1997). Positive transformants are selected after growing the transformed cells on plates containing 50–100 µg/ml Ampicillin (Sigma, St. Louis, Mo.). In one embodiment, the expressed protein is held in the cytoplasm of the host organism. In an alternate embodiment, the expressed protein is released into the culture medium. In still another alternative, the expressed protein can be sequestered in the periplasmic space and liberated therefrom using any one of a number of cell lysis techniques known in the art. For example, the osmotic shock cell lysis method described in Chapter 16 of Current Protocols in Molecular Biology, Vol. 2, (Ausubel, et al., Eds.) John Wiley & Sons, Inc. (1997). Each of these procedures can be used to express a proliferation-required protein.

Expressed proteins, whether in the culture medium or liberated from the periplasmic space or the cytoplasm, are then purified or enriched from the supernatant using conventional techniques such as ammonium sulfate precipitation, standard chromatography, immunoprecipitation, immunochromatography, size exclusion chromatography, ion exchange chromatography, and HPLC. Alternatively, the secreted protein can be in a sufficiently enriched or pure state in the supernatant or growth media of the host to permit it to be used for its intended purpose without further enrichment. The purity of the protein product obtained can be assessed using techniques such as Coomassie or silver staining or using antibodies against the control protein. Coomassie and silver staining techniques are familiar to those skilled in the art.

Antibodies capable of specifically recognizing the protein of interest can be generated using synthetic peptides using methods well known in the art. See, Antibodies: A Laboratory Manual, (Harlow and Lane, Eds.) Cold Spring Harbor Laboratory (1988). For example, 15-mer peptides having a sequence encoded by the appropriate identified gene sequence of interest or portion thereof can be chemically synthesized. The synthetic peptides are injected into mice to generate antibodies to the polypeptide encoded by the identified nucleic acid sequence of interest or portion thereof. Alternatively, samples of the protein expressed from the expression vectors discussed above can be purified and subjected to amino acid sequencing analysis to confirm the identity of the recombinantly expressed protein and subsequently used to raise antibodies. An Example describing in detail the generation of monoclonal and polyclonal antibodies appears in Example 7.

The protein encoded by the identified nucleic acid sequence of interest or portion thereof can be purified using standard immunochromatography techniques. In such procedures, a solution containing the secreted protein, such as the culture medium or a cell extract, is applied to a column having antibodies against the secreted protein attached to the chromatography matrix. The secreted protein is allowed to bind the immunochromatography column. Thereafter, the column is washed to remove non-specifically bound proteins. The specifically bound secreted protein is then released from the column and recovered using standard techniques. These procedures are well known in the art.

In an alternative protein purification scheme, the identified nucleic acid sequence of interest or portion thereof can be incorporated into expression vectors designed for use in purification schemes employing chimeric polypeptides. In such strategies the coding sequence of the identified nucleic acid sequence of interest or portion thereof is inserted in-frame with the gene encoding the other half of the chimera. The other half of the chimera can be maltose binding protein (MBP) or a nickel binding polypeptide encoding sequence. A chromatography matrix having antibody to MBP or nickel attached thereto is then used to purify the chimeric protein. Protease cleavage sites can be engineered between the MBP gene or the nickel binding polypeptide and the identified expected gene of interest, or portion thereof. Thus, the two polypeptides of the chimera can be separated from one another by protease digestion.

One useful expression vector for generating maltose binding protein fusion proteins is pMAL (New England Biolabs), which encodes the malE gene. In the pMal protein fusion system, the cloned gene is inserted into a pMal vector downstream from the malE gene. This results in the expression of an MBP-fusion protein. The fusion protein is purified by affinity chromatography. These techniques as described are well known to those skilled in the art of molecular biology.

Example 7

Production of an Antibody to an Isolated E. coli Protein

Substantially pure protein or polypeptide is isolated from the transformed cells as described in Example 6. The concentration of protein in the final preparation is adjusted, for example, by concentration on a 10,000 molecular weight cut off AMICON filter device (Millipore, Bedford, Mass.), to the level of a few micrograms/ml. Monoclonal or polyclonal antibody to the protein can then be prepared as follows:

Monoclonal Antibody Production by Hybridoma Fusion

Monoclonal antibody to epitopes of any of the peptides identified and isolated as described can be prepared from murine hybridomas according to the classical method of Kohler, G. and Milstein, C., Nature 256:495 (1975) or any of the well-known derivative methods thereof. Briefly, a mouse is repetitively inoculated with a few micrograms of the selected protein or peptides derived therefrom over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as described by Engvall, E., "Enzyme immunoassay ELISA and EMIT," Meth. Enzymol. 70:419 (1980), and derivative methods thereof. Selected positive clones can be expanded and their monoclonal antibody product harvested for use. Detailed procedures for monoclonal antibody production are described in Davis, L. et al. Basic Methods in Molecular Biology Elsevier, N.Y. Section 21-2.

Polyclonal Antibody Production by Immunization

Polyclonal antiserum containing antibodies to heterogeneous epitopes of a single protein or a peptide can be prepared by immunizing suitable animals with the expressed protein or peptides derived therefrom described above, which can be unmodified or modified to enhance immunogenicity. Effective polyclonal antibody production is affected by many factors related both to the antigen and the host species. For example, small molecules tend to be less immunogenic than larger molecules and can require the use of carriers and adjuvant. Also, host animals vary in response to site of inoculations and dose, with both inadequate or excessive doses of antigen resulting in low titer antisera. Small doses (ng level) of antigen administered at multiple intradermal sites appears to be most reliable. An effective immunization protocol for rabbits can be found in Vaitukaitis, J. et al. J. Clin. Endocrinol. Metab. 33:988–991 (1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in: Handbook of Experimental Immunology D. Wier (ed) Blackwell (1973). Plateau concentration of antibody is usually in the range of 0.1 to 0.2 mg/ml of serum (about 12 $\mu$M). Affinity of the antisera for the antigen is determined by preparing competitive binding curves, as described, for example, by Fisher, D., Chap. 42 in: Manual of Clinical Immunology, 2d Ed. (Rose and Friedman, Eds.) Amer. Soc. For Microbiol., Washington, D.C. (1980).

Antibody preparations prepared according to either protocol are useful in quantitative immunoassays which determine concentrations of antigen-bearing substances in biological samples; they are also used semi-quantitatively or qualitatively to identify the presence of antigen in a biological sample. The antibodies can also be used in therapeutic compositions for killing bacterial cells expressing the protein.

Example 8

Screening Chemical Libraries

A. Protein-Based Assays

Having isolated and expressed bacterial proteins shown to be required for bacterial proliferation, the present invention further contemplates the use of these expressed proteins in assays to screen libraries of compounds for potential drug candidates. The generation of chemical libraries is well known in the art. For example combinatorial chemistry can be used to generate a library of compounds to be screened in the assays described herein. A combinatorial chemical library is a collection of diverse chemical compounds generated by either chemical synthesis or biological synthesis by combining a number of chemical "building blocks" reagents. For example, a linear combinatorial chemical library such as a polypeptide library is formed by combining amino acids in every possible combination to yield peptides of a given length. Millions of chemical compounds theoretically can be synthesized through such combinatorial mixings of chemical building blocks. For example, one commentator observed that the systematic, combinatorial mixing of 100 interchangeable chemical building blocks results in the theoretical synthesis of 100 million tetrameric compounds or 10 billion pentameric compounds. (Gallop et al., "Applications of Combinatorial Technologies to Drug Discovery, Background and Peptide Combinatorial Libraries," Journal of Medicinal Chemistry, Vol. 37, No. 9, 1233–1250 (1994). Other chemical libraries known to those in the art may also be used, including natural product libraries.

Once generated, combinatorial libraries can be screened for compounds that possess desirable biological properties. For example, compounds which may be useful as drugs or to develop drugs would likely have the ability to bind to the target protein identified, expressed and purified as discussed above. Further, if the identified target protein is an enzyme, candidate compounds would likely interfere with the enzymatic properties of the target protein. Any enzyme can be a target protein. For example, the enzymatic function of a target protein can be to serve as a protease, nuclease, phosphatase, dehydrogenase, transporter protein, transcriptional enzyme, and any other type of enzyme known or unknown. Thus, the present invention contemplates using the protein products described above to screen combinatorial and other chemical libraries.

Those in the art will appreciate that a number of techniques exist for characterizing target proteins in order to identify molecules useful for the discovery and development of therapeutics. For example, some techniques involve the generation and use of small peptides to probe and analyze target proteins both biochemically and genetically in order to identify and develop drug leads. Such techniques include the methods described in PCT publications Nos. WO9935494, WO9819162, WO9954728, the disclosures of which are incorporated herein by reference in their entireties.

In another example, the target protein is a serine protease and the substrate of the enzyme is known. The present example is directed towards the analysis of libraries of compounds to identify compounds that function as inhibitors of the target enzyme. First, a library of small molecules is generated using methods of combinatorial library formation well known in the art. U.S. Pat. Nos. 5,463,564 and 5,574,656, to Agrafiotis, et al., entitled "System and Method of Automatically Generating Chemical Compound with Desired Properties," are two such teachings. Then the library compounds are screened to identify library compounds that possess desired structural and functional properties. U.S. Pat. No. 5,684,711 also discusses a method for screening libraries.

To illustrate the screening process, the combined target and chemical compounds of the library are exposed to and permitted to interact with the purified enzyme. A labeled substrate is added to the incubation. The label on the substrate is such that a detectable signal is emitted from metabolized substrate molecules. The emission of this signal permits one to measure the effect of the combinatorial library compounds on the enzymatic activity of target enzymes. The characteristics of each library compound is encoded so that compounds demonstrating activity against the enzyme can be analyzed and features common to the various compounds identified can be isolated and combined into future iterations of libraries.

Once a library of compounds is screened, subsequent libraries are generated using those chemical building blocks that possess the features shown in the first round of screen to have activity against the target enzyme. Using this method, subsequent iterations of candidate compounds will possess more and more of those structural and functional features required to inhibit the finction of the target enzyme, until a group of enzyme inhibitors with high specificity for the enzyme can be found. These compounds can then be further tested for their safety and efficacy as antibiotics for use in mammals.

It will be readily appreciated that this particular screening methodology is exemplary only. Other methods are well known to those skilled in the art. For example, a wide variety of screening techniques are known for a large number of naturally-occurring targets when the biochemical function of the target protein is known.

B. Cell Based Assays

Current cell-based assays used to identify or to characterize compounds for drug discovery and development frequently depend on detecting the ability of a test compound to inhibit the activity of a target molecule located within a cell or located on the surface of a cell. Most often such target molecules are proteins such as enzymes, receptors and the like. However, target molecules may also include other molecules such as DNAs, lipids, carbohydrates and RNAs including messenger RNAs, ribosomal RNAs, tRNAs and the like. A number of highly sensitive cell-based assay methods are available to those of skill in the art to detect binding and interaction of test compounds with specific target molecules. However, these methods are generally not highly effective when the test compound binds to or otherwise interacts with its target molecule with moderate or low affinity. In addition, the target molecule may not be readily accessible to a test compound in solution, such as when the target molecule is located inside the cell or within a cellular compartment such as the periplasm of a bacterial cell. Thus, current cell-based assay methods are limited in that they are not effective in identifying or characterizing compounds that interact with their targets with moderate to low affinity or compounds that interact with targets that are not readily accessible.

Cell-based assay methods of the present invention have substantial advantages over current cell-based assays practiced in the art. These advantages derive from the use of sensitized cells in which the level or activity of a proliferation-required gene product (the target molecule) has been specifically reduced to the point where the presence or absence of its function becomes a rate-determining step for cellular proliferation. Bacterial, fungal, plant, or animal cells can all be used with the present method. Such sensitized cells become much more sensitive to compounds that are active against the affected target molecule. Thus, cell-based assays of the present invention are capable of detecting compounds exhibiting low or moderate potency against the target molecule of interest because such compounds are substantially more potent on sensitized cells than on non-sensitized cells. The affect may be such that a test compound may be two to several times more potent, at least 10 times more potent or even at least 100 times more potent when tested on the sensitized cells as compared to the non-sensitized cells.

Due in part to the increased appearance of antibiotic resistance in pathogenic microorganisms and to the significant side-effects associated with some currently used antibiotics, novel antibiotics acting at new targets are highly sought after in the art. Yet, another limitation in the current art related to cell-based assays is the problem of identifying hits against the same kinds of target molecules in the same limited set of biological pathways over and over again. This may occur when compounds acting at such new targets are discarded, ignored or fail to be detected because compounds acting at the "old" targets are encountered more frequently and are more potent than compounds acting at the new targets. As a result, the majority of antibiotics in use currently interact with a relatively small number of target molecules within an even more limited set of biological pathways.

The use of sensitized cells of the current invention provides a solution to the above problem in two ways. First, desired compounds acting at a target of interest, whether a new target or a previously known but poorly exploited target, can now be detected above the "noise" of compounds acting at the "old" targets due to the specific and substantial increase in potency of such desired compounds when tested on the sensitized cells of the current invention. Second, the methods used to sensitize cells to compounds acting at a target of interest may also sensitize these cells to compounds acting at other target molecules within the same biological pathway. For example, expression of an antisense molecule to a gene encoding a ribosomal protein is expected to sensitize the cell to compounds acting at that ribosomal protein and may also sensitize the cells to compounds acting at any of the ribosomal components (proteins or rRNA) or even to compounds acting at any target which is part of the protein synthesis pathway. Thus an important advantage of the present invention is the ability to reveal new targets and pathways that were previously not readily accessible to drug discovery methods.

Sensitized cells of the present invention are prepared by reducing the activity or level of a target molecule. The target molecule may be a gene product, such as an RNA or polypeptide produced from the proliferation-required nucleic acids described herein. Alternatively, the target may be a gene product such as an RNA or polypeptide which is produced form a sequence within the same operon as the proliferation-required nucleic acids described herein. In addition, the target may be an RNA or polypeptide in the same biological pathway as the proliferation-required nucleic acids described herein. Such biological pathways include, but are not limited to, enzymatic, biochemical and metabolic pathways as well as pathways involved in the production of cellular structures such the cell wall.

Current methods employed in the arts of medicinal and combinatorial chemistries are able to make use of structure-activity relationship information derived from testing compounds in various biological assays including direct binding assays and cell-based assays. Occasionally compounds are directly identified in such assays that are sufficiently potent to be developed as drugs. More often, initial hit compounds exhibit moderate or low potency. Once a hit compound is identified with low or moderate potency, directed libraries of compounds are synthesized and tested in order to identify more potent leads. Generally these directed libraries are combinatorial chemical libraries consisting of compounds with structures related to the hit compound but containing systematic variations including additions, subtractions and substitutions of various structural features. When tested for activity against the target molecule, structural features are identified that either alone or in combination with other features enhance or reduce activity. This information is used to design subsequent directed libraries containing compounds with enhanced activity against the target molecule. After one or several iterations of this process, compounds with substantially increased activity against the target molecule are identified and may be further developed as drugs. This process is facilitated by use of the sensitized cells of the present invention since compounds acting at the selected targets exhibit increased potency in such cell-based assays, thus; more compounds can now be characterized providing more useful information than would be obtained otherwise.

Thus, it is now possible using cell-based assays of the present invention to identify or characterize compounds that previously would not have been readily identified or characterized including compounds that act at targets that previously were not readily exploited using cell-based assays. The process of evolving potent drug leads from initial hit compounds is also substantially improved by the cell-based assays of the present invention because, for the same number of test compounds, more structure-function relationship information is likely to be revealed.

The method of sensitizing a cell entails selecting a suitable gene or operon. A suitable gene or operon is one whose expression is required for the proliferation of the cell to be sensitized. The next step is to introduce into the cells to be sensitized, an antisense RNA capable of hybridizing to the suitable gene or operon or to the RNA encoded by the suitable gene or operon. Introduction of the antisense RNA can be in the form of an expression vector in which antisense RNA is produced under the control of an inducible promoter. The amount of antisense RNA produced is limited by varying the inducer concentration to which the cell is exposed and thereby varying the activity of the promoter driving transcription of the antisense RNA. Thus, cells are sensitized by exposing them to an inducer concentration that results in a sub-lethal level of antisense RNA expression.

In one embodiment of the cell-based assays, the identified exogenous *E. coli* nucleotide sequences of the present invention are used to inhibit the production of a proliferation-required protein. Expression vectors producing antisense RNA against identified genes required for proliferation are used to limit the concentration of a proliferation-required protein without severly inhibiting growth. To achieve that goal, a growth inhibition dose curve of inducer is calculated by plotting various doses of inducer against the corresponding growth inhibition caused by the antisense expression. From this curve, various percentages of antisense induced growth inhibition, from 1 to 100% can be determined. If the promoter contained in the expression vector contains a lac operator the transcription is regulated by lac repressor and expression from the promoer is inducible with IPTG. For example, the highest concentration of the inducer IPTG that does not reduce the growth rate (0% growth inhibition) can be predicted from the curve. Cellular proliferation can be monitored by growth medium turbidity via OD measurements. In another example, the concentration of inducer that reduces growth by 25% can be predicted from the curve. In still another example, a concentration of inducer that reduces growth by 50% can be calculated. Additional parameters such as colony forming units (cfu) can be used to measure cellular viability.

Cells to be assayed are exposed to the above-determined concentrations of inducer. The presence of the inducer at this sub-lethal concentration reduces the amount of the proliferation required gene product to a low amount in the cell that will limit but not prevent growth. Cells grown in the presence of this concentration of inducer are therefore specifically more sensitive to inhibitors of the proliferation-required protein or RNA of interest or to inhibitors of proteins or RNAs in the same biological pathway as the proliferation-required protein or RNA of interest but not to inhibitors of unrelated proteins or RNAs.

Cells pretreated with sub-inhibitory concentrations of inducer and thus containing a reduced amount of proliferation-required target gene product are then used to screen for compounds that reduce cell growth. The sub-lethal concentration of inducer may be any concentration consistent with the intended use of the assay to identify candidate compounds to which the cells are more sensitive. For example, the sub-lethal concentration of the inducer may be such that growth inhibition is at least about 5%, at least about 8%, at least about 10%, at least about 20%, at least about 30%, at least about 40%, at least about 50%, at least about 60% at least about 75%, 90%, 95% or more. Cells which are pre-sensitized using the preceding method are more sensitive to inhibitors of the target protein because these cells contain less target protein to be inhibited than do wild-type cells.

In another embodiment of the cell based assays of the present invention, the level or activity of a proliferation required gene product is reduced using a mutation, such as a temperature sensitive mutation, in the proliferation-required sequence and an antisense nucleic acid against the proliferation-required sequence. Growing the cells at an intermediate temperature between the permissive and restrictive temperatures of the temperature sensitive mutant where the mutation is in a proliferation-required gene produces cells with reduced activity of the proliferation-required gene product. The antisense RNA directed against the proliferation-required sequence further reduces the activity of the proliferation required gene product. Drugs that may not have been found using either the temperature sensitive mutation or the antisense nucleic acid alone may be identified by determining whether cells in which expression of the antisense nucleic acid has been induced and which are grown at a temperature between the permissive temperature and the restrictive temperature are substantially more sensitive to a test compound than cells in which expression of the antisense nucleic acid has not been induced and which are grown at a permissive temperature. Also drugs found previously from either the antisense nucleic acid alone or the temperature sensitive mutation alone may have a different sensitivity profile when used in cells combining the two approaches, and that sensitivity profile may indicate a more specific action of the drug in inhibiting one or more activities of the gene product.

Temperature sensitive mutations may be located at different sites within the gene and correspond to different domains of the protein. For example, the dnaB gene of *Escherichia coli* encodes the replication fork DNA helicase. DnaB has several domains, including domains for oligomerization, ATP hydrolysis, DNA binding, interaction with primase, interaction with DnaC, and interaction with DnaA [(Biswas, E. E. and Biswas, S. B. 1999. Mechanism and DnaB helicase of *Escherichia coli*: structural domains involved in ATP hydrolysis, DNA binding, and oligomerization. Biochem. 38:10919–10928; Hiasa, H. and Marians, K. J. 1999. Initiation of bidirectional replication at the chromosomal origin is directed by the interaction between helicase and primase. J. Biol. Chem. 274:27244–27248; San Martin, C., Radermacher, M., Wolpensinger, B., Engel, A., Miles, C. S., Dixon, N. E., and Carazo, J. M. 1998. Three-dimensional reconstructions from cryoelectron microscopy images reveal an intimate complex between helicase DnaB and its loading partner DnaC. Structure 6:501–9; Sutton, M. D., Carr, K. M., Vicente, M., and Kaguni, J. M. 1998. *Escherichia coli* DnaA protein. The N-terminal domain and loading of DnaB helicase at the *E. coli* chromosomal. J. Biol. Chem. 273:34255–62.), the disclosures of which are incorporated herein by reference in their entireties]. Temperature sensitive mutations in different domains of DnaB confer different phenotypes at the restrictive temperature, which include either an abrupt stop or slow stop in DNA replication with or without DNA breakdown (Wechsler, J. A. and Gross, J. D. 1971. *Escherichia coli* mutants temperature-sensitive for DNA synthesis. Mol. Gen. Genetics 113:273–284, the disclosure of which is incorporated herein by reference in its entirety) and termination of growth or cell death. Combining the use of temperature sensitive mutations in the dnaB gene that cause cell death at the restrictive temperature with an antisense to the dnaB gene could lead to the discovery of very specific and effective inhibitors of one or a subset of activities exhibited by DnaB.

When screening for antimicrobial agents against a gene product required for proliferation, growth inhibition of cells containing a limiting amount of that proliferation-required gene product can be assayed. Growth inhibition can be measured by directly comparing the amount of growth, measured by the optical density of the growth medium, between an experimental sample and a control sample. Alternative methods for assaying cell proliferation include measuring green fluorescent protein (GFP) reporter construct emissions, various enzymatic activity assays, and other methods well known in the art.

It will be appreciated that the above method may be performed in solid phase, liquid phase or a combination of the two. For example, cells grown on nutrient agar containing the inducer of the antisense construct may be exposed to compounds spotted onto the agar surface. A compound's effect may be judged from the diameter of the resulting killing zone, the area around the compound application point in which cells do not grow. Multiple compounds may be transferred to agar plates and simultaneously tested using automated and semi-automated equipment including but not restricted to multi-channel pipettes (for example the Beckman Multimek) and multi-channel spotters (for example the Genomic Solutions Flexys). In this way multiple plates and thousands to millions of compounds may be tested per day.

The compounds may also be tested entirely in liquid phase using microtiter plates as described below. Liquid phase screening may be performed in microtiter plates containing 96, 384, 1536 or more wells per microtiter plate to screen multiple plates and thousands to millions of compounds per day. Automated and semi-automated equipment may be used for addition of reagents (for example cells and compounds) and determination of cell density.

Example 9

Cell Based Assay Using Antisense Complementary to Genes Encoding Ribosomal Proteins The effectiveness of the above cell based assay was validated using constructs expressing antisense RNA to the proliferation required *E. coli* genes rplL, rplJ, and rplW encoding ribosomal proteins L7/L12, L10 and L23 respectively. These proteins are part of the protein synthesis apparatus of the cell and as such are required for proliferation. These constructs were used to test the effect of antisense expression on cell sensitivity to antibiotics known to bind to the ribosome and thereby inhibit protein synthesis. Constructs expressing antisense RNA to several other genes (elaD, visC, yohH, and atpE/B), the products of which are not involved in protein synthesis were used for comparison.

First pLex5BA (Krause et al., J. Mol. Biol. 274: 365 (1997), the disclosure of which is incorporated herein by reference in its entirety) expression vectors containing antisense constructs to either rplW or to elaD were introduced into separate *E. coli* cell populations. Vector introduction is a technique well known to those of ordinary skill in the art. The expression vectors of this example contain IPTG inducible promoters that drive the expression of the antisense RNA in the presence of the inducer. However, those skilled in the art will appreciate that other inducible promoters may also be used. Suitable expression vectors are also well known in the art. The *E. coli* antisense clones encoding ribosomal proteins L7/L12, L10 and L23 were used to test the effect of antisense expression on cell sensitivity to the antibiotics known to bind to these proteins. First, expression vectors containing antisense to either the genes encoding L7/L12 and L10 or L23 were introduced into separate *E. coli* cell populations.

The cell populations were exposed to a range of IPTG concentrations in liquid medium to obtain the growth inhibitory dose curve for each clone (FIG. 1). First, seed cultures were grown to a particular turbidity that is measured by the optical density (OD) of the growth solution. The OD of the solution is directly related to the number of bacterial cells contained therein. Subsequently, sixteen 200 ul liquid medium cultures were grown in a 96 well microtiter plate at 37 C with a range of IPTG concentrations in duplicate two-fold serial dilutions from 1600 uM to 12.5 uM (final concentration). Additionally, control cells were grown in duplicate without IPTG. These cultures were started from equal amounts of cells derived from the same initial seed culture of a clone of interest. The cells were grown for up to 15 hours and the extent of growth was determined by measuring the optical density of the cultures at 600 nm. When the control culture reached mid-log phase the percent growth of the control for each of the IPTG containing cultures was plotted against the log concentrations of IPTG to produce a growth inhibitory dose response curve for the IPTG. The concentration of IPTG that inhibits cell growth to 50% ($IC_{50}$) as compared to the 0 mM IPTG control (0% growth inhibition) was then calculated from the curve. Under these conditions, an amount of antisense RNA was produced that reduced the expression levels of rplW and elaD to a degree such that growth was inhibited by 50%.

Alternative methods of measuring growth are also contemplated. Examples of these methods include measurements of proteins, the expression of which is engineered into the cells being tested and can readily be measured. Examples of such proteins include green fluorescent protein (GFP) and various enzymes.

Cells were pretreated with the selected concentration of IPTG and then used to test the sensitivity of cell populations to tetracycline, erythromycin and other protein synthesis inhibitors. FIG. 2 is an IPTG dose response curve in *E. coli* transformed with an IPTG-inducible plasmid containing either an antisense clone to the *E. coli* ribosomal protein rplW (AS-rplW) which is required for protein synthesis and essential for cell proliferation, or an antisense clone to the elaD (AS-elaD) gene which is not known to be involved in protein synthesis and which is also essential for proliferation.

Figure 2A:
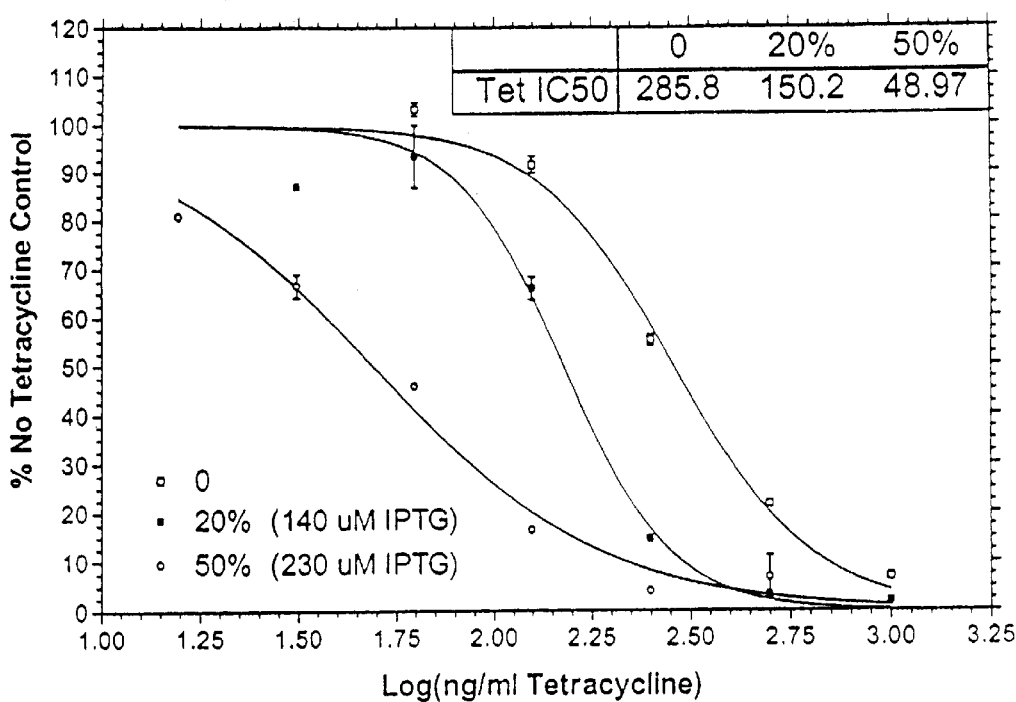
FIG. 2A is a tetracycline dose response curve in *E. coli* transformed with an IPTG-inducible plasmid containing antisense to rplW gene (AS-rplW) carried out in the presence of 0, 20 or 50 $\mu$M IPTG.
Figure 2B:
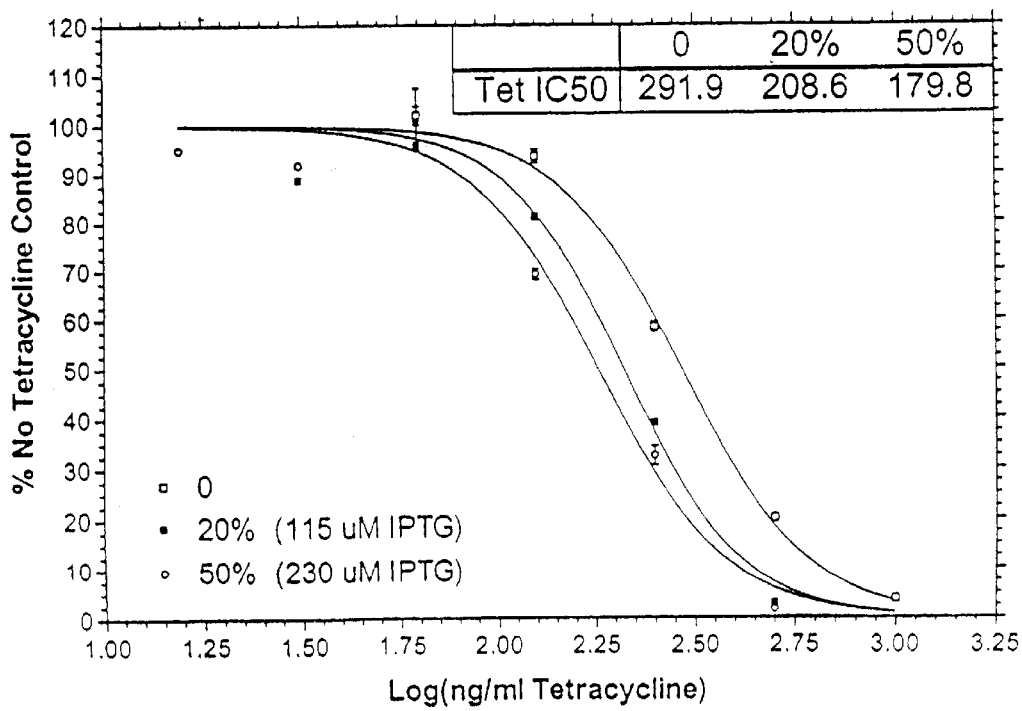
FIG. 2B is a tetracycline dose response curve in *E. coli* transformed with an IPTG-inducible plasmid containing antisense to elaD gene (AS-elaD) carried out in the presence of 0, 20 or 50 $\mu$M IPTG.
Figure 3:
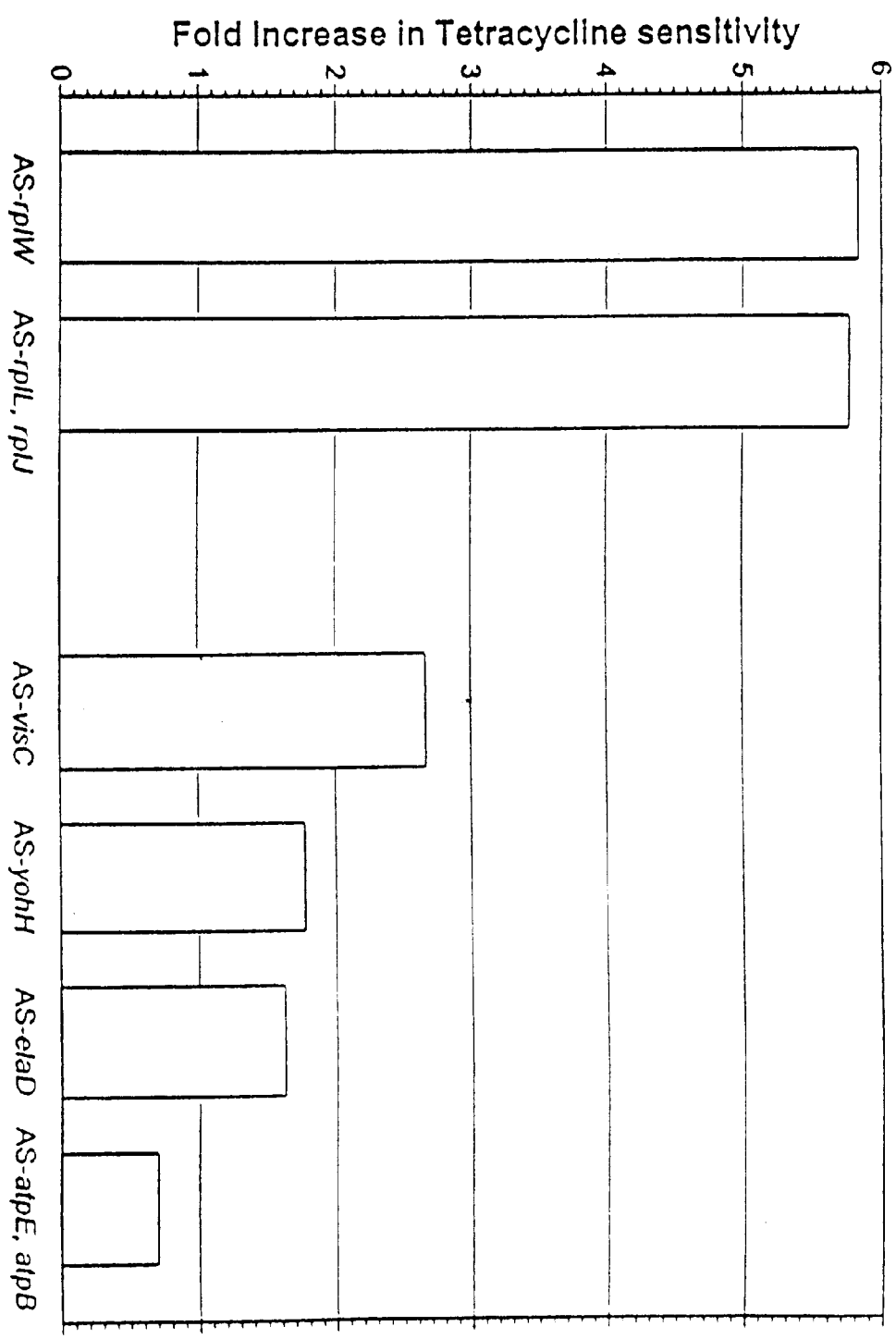
FIG. 3 is a graph showing the fold increase in tetracycline sensitivity of *E. coli* transfected with antisense clones to essential ribosomal protein genes L23 (AS-rplW) and L7/L12 and L10 (AS-rplLrplJ). Antisense clones to genes known not to be involved in protein synthesis (atpB/E(AS-atpB/E), visC (AS-visC), elaD (AS-elaD), yohH (AS-yohH) are much less sensitive to tetracycline.

An example of a tetracycline dose response curve is shown in FIGS. 2A and 2B for the rplW and elaD genes, respectively. Cells were grown to log phase and then diluted into media alone or media containing IPTG at concentrations which give 20% and 50% growth inhibition as determined by IPTG dose response curves. After 2.5 hours, the cells were diluted to a final OD600 of 0.002 into 96 well plates containing (1) +/− IPTG at the same concentrations used for the 2.5 hour pre-incubation; and (2) serial two-fold dilutions of tetracycline such that the final concentrations of tetracycline range from 1 µg/ml to 15.6 ng/ml and 0 µg/ml. The 96 well plates were incubated at 37° C. and the OD600 was read by a plate reader every 5 minutes for up to 15 hours. For each IPTG concentration and the no IPTG control, tetracycline dose response curves were determined when the control (absence of tetracycline) reached 0.1 OD600. To compare tetracycline sensitivity with and without IPTG, tetracycline $IC_{50s}$ were determined from the dose response curves (FIGS. 3A–B). Cells with reduced levels of L23 (rplW) showed increased sensitivity to tetracycline (FIG. 2A) as compared to cells with reduced levels of elaD (FIG. 2B). FIG. 3 shows a summary bar chart in which the ratios of tetracycline $IC_{50s}$ determined in the presence of IPTG which gives 50% growth inhibition versus tetracycline $IC_{50s}$ determined without IPTG (fold increase in tetracycline sensitivity) were plotted. Cells with reduced levels of either L7/L12 (genes rplL, rplJ) or L23 (rplW) showed increased sensitivity to tetracycline (FIG. 3). Cells expressing antisense to genes not known to be involved in protein synthesis (atpB/E, visC, elaD, yohH) did not show the same increased sensitivity to tetracycline, validating the specificity of this assay (FIG. 3).

In addition to the above, it has been observed in initial experiments that clones expressing antisense RNA to genes involved in protein synthesis (including genes encoding ribosomal proteins L7/L12 & L10, L7/L12 alone, L22, and L18, as well as genes encoding rRNA and Elongation Factor G) have increased sensitivity to the macrolide, erythromycin, whereas clones expressing antisense to the non-protein synthesis genes elaD, atpB/E and visC do not. Furthermore, the clone expressing antisense to rplL and rplJ does not show increased sensitivity to nalidixic acid and ofloxacin, antibiotics which do not inhibit protein synthesis.

The results with the ribosomal protein genes rplL, rplJ, and rplW as well as the initial results using various other antisense clones and antibiotics show that limiting the concentration of an antibiotic target makes cells more sensitive to the antimicrobial agents that specifically interact with that protein. The results also show that these cells are sensitized to antimicrobial agents that inhibit the overall function in which the protein target is involved but are not sensitized to antimicrobial agents that inhibit other functions.

The cell based assay described above may also be used to identify the biological pathway in which a proliferation-required nucleic acid or its gene product lies. In such methods, cells expressing a sub-lethal level of antisense to a target proliferation-required nucleic acid and control cells in which expression of the antisense has not been induced are contacted with a panel of antibiotics known to act in various pathways. If the antibiotic acts in the pathway in which the target proliferation-required nucleic acid or its gene product lies, cells in which expression of the antisense has been induced will be more sensitive to the antibiotic than cells in which expression of the antisense has not been induced.

As a control, the results of the assay may be confirmed by contacting a panel of cells expressing antisense nucleic acids to many different proliferation-required genes including the target proliferation-required gene. If the antibiotic is acting specifically, heightened sensitivity to the antibiotic will be observed only in the cells expressing antisense to a target proliferation-required gene (or cells expressing antisense to other proliferation-required genes in the same pathway as the target proliferation-required gene) but will not be observed generally in all cells expressing antisense to proliferation-required genes.

Similarly, the above method may be used to determine the pathway on which a test compound, such as a test antibiotic acts. A panel of cells, each of which expresses antisense to a proliferation-required nucleic acid in a known pathway, is contacted with a compound for which it is desired to determine the pathway on which it acts. The sensitivity of the panel of cells to the test compound is determined in cells in which expression of the antisense has been induced and in control cells in which expression of the antisense has not been induced. If the test compound acts on the pathway on which an antisense nucleic acid acts, cells in which expression of the antisense has been induced will be more sensitive to the compound than cells in which expression of the antisense has not been induced. In addition, control cells in which expression of antisense to proliferation-required genes in other pathways has been induced will not exhibit heightened sensitivity to the compound. In this way, the pathway on which the test compound acts may be determined.

The Example below provides one method for performing such assays.

Example 10

Identification of the Pathway in Which a Proliferation-Required Gene Lies or the Pathway on Which an Antibiotic Acts A. Preparation of Bacterial Stocks for Assay To provide a consistent source of cells to screen, frozen stocks of host bacteria containing the desired antisense construct are prepared using standard microbiological techniques. For example, a single clone of the organism can be isolated by streaking out a sample of the original stock onto an agar plate containing nutrients for cell growth and an antibiotic for which the antisense construct contains a gene which confers resistance. After overnight growth an isolated colony is picked from the plate with a sterile needle and transferred to an appropriate liquid growth media containing the antibiotic required for maintenance of the plasmid. The cells are incubated at 30° C. to 37° C. with vigorous shaking for 4 to 6 hours to yield a culture in exponential growth. Sterile glycerol is added to 15% (volume to volume) and 100 µL to 500 µL aliquots are distributed into sterile cryotubes, snap frozen in liquid nitrogen, and stored at −80° C. for future assays.

B. Growth of Bacteria for Use in the Assay

A day prior to an assay, a stock vial is removed from the freezer, rapidly thawed (37° C. water bath) and a loop of culture is streaked out on an agar plate containing nutrients for cell growth and an antibiotic to which the antisense construct confers resistance. After overnight growth at 37° C., ten randomly chosen, isolated colonies are transferred from the plate (sterile inoculum loop) to a sterile tube containing 5 mL of LB medium containing the antibiotic to which the antisense vector confers resistance. After vigorous mixing to form a homogeneous cell suspension, the optical density of the suspension is measured at 600 nm (OD600) and if necessary an aliquot of the suspension is diluted into a second tube of 5 mL, sterile, LB medium plus antibiotic to achieve an OD600≦0.02 absorbance units. The culture is then incubated at 37° C. for 1–2 hrs with shaking until the OD600 reaches OD 0.2–0.3. At this point the cells are ready to be used in the assay.

C. Selection of Media to be Used in Assay

Two fold dilution series of the inducer are generated in culture media containing the appropriate antibiotic for maintenance of the antisense construct. Several media are tested side by side and three to four wells are used to evaluate the effects of the inducer at each concentration in each media. For example, M9 minimal media, LB broth, TBD broth and Muller-Hinton media may be tested with the inducer IPTG at the following concentrations, 50 μM, 100 μM, 200 μM, 400 μM, 600 μM, 800 μM and 1000 μM. Equal volumes of test media-inducer and cells are added to the wells of a 384 well microtiter plate and mixed. The cells are prepared as described above and diluted 1:100 in the appropriate media containing the test antibiotic immediately prior to addition to the microtiter plate wells. For a control, cells are also added to several wells of each media that do not contain inducer, for example 0 μM IPTG. Cell growth is monitored continuously by incubation at 37° C. in a microtiter plate reader monitoring the OD600 of the wells over an 18-hour period. The percent inhibition of growth produced by each concentration of inducer is calculated by comparing the rates of logarithmic growth against that exhibited by cells growing in media without inducer. The medium yielding greatest sensitivity to inducer is selected for use in the assays described below.

D. Measurement of Test Antibiotic Sensitivity in the Absence of Antisense Construct Induction Two-fold dilution series of antibiotics of known mechanism of action are generated in the culture media selected for further assay development that has been supplemented with the antibiotic used to maintain the construct. A panel of test antibiotics known to act on different pathways is tested side by side with three to four wells being used to evaluate the effect of a test antibiotic on cell growth at each concentration. Equal volumes of test antibiotic and cells are added to the wells of a 384 well microtiter plate and mixed. Cells are prepared as described above using the media selected for assay development supplemented with the antibiotic required to maintain the antisense construct and are diluted 1:100 in identical media immediately prior to addition to the microtiter plate wells. For a control, cells are also added to several wells that contain the solvent used to dissolve the antibiotics but no antibiotic. Cell growth is monitored continuously by incubation at 37° C. in a microtiter plate reader monitoring the OD600 of the wells over an 18-hour period. The percent inhibition of growth produced by each concentration of antibiotic is calculated by comparing the rates of logarithmic growth against that exhibited by cells growing in media without antibiotic. A plot of percent inhibition against log[antibiotic concentration] allows extrapolation of an $IC_{50}$ value for each antibiotic.

E. Measurement of Test Antibiotic Sensitivity in the Presence of Antisense Construct Inducer The culture media selected for use in the assay is supplemented with inducer at concentrations shown to inhibit cell growth by 50 and 80% as described above and the antibiotic used to maintain the construct. Two fold dilution series of the panel of test antibiotics used above are generated in each of these media. Several antibiotics are tested side by side with three to four wells being used to evaluate the effects of an antibiotic on cell growth at each concentration, in each media. Equal volumes of test antibiotic and cells are added to the wells of a 384 well microtiter plate and mixed. Cells are prepared as described above using the media selected for use in the assay supplemented with the antibiotic required to maintain the antisense construct. The cells are diluted 1:100 into two 50 mL aliquots of identical media containing concentrations of inducer that have been shown to inhibit cell growth by 50% and 80% respectively and incubated at 37° C. with shaking for 2.5 hours. Immediately prior to addition to the microtiter plate wells, the cultures are adjusted to an appropriate $OD_{600}$ (typically 0.002) by dilution into warm (37° C.) sterile media supplemented with identical concentrations of the inducer and antibiotic used to maintain the antisense construct. For a control, cells are also added to several wells that contain solvent used to dissolve test antibiotics but which contain no antibiotic. Cell growth is monitored continuously by incubation at 37° C. in a microtiter plate reader monitoring the OD600 of the wells over an 18-hour period. The percent inhibition of growth produced by each concentration of antibiotic is calculated by comparing the rates of logarithmic growth against that exhibited by cells growing in media without antibiotic. A plot of percent inhibition against log[antibiotic concentration] allows extrapolation of an $IC_{50}$ value for each antibiotic.

F. Determining the Specificity of the Test Antibiotics

A comparison of the $IC_{50}$s generated by antibiotics of known mechanism of action under antisense induced and non-induced conditions allows the pathway in which a proliferation-required nucleic acid lies to be identified. If cells expressing an antisense nucleic acid against a proliferation-required gene are selectively sensitive to an antibiotic acting via a particular pathway, then the gene against which the antisense acts is involved in the pathway in which the antibiotic acts.

G. Identification of Pathway in Which a Test Antibiotic Acts

As discussed above, the cell based assay may also be used to determine the pathway against which a test antibiotic acts. In such an analysis, the pathways against which each member of a panel of antisense nucleic acids acts are identified as described above. A panel of cells, each containing an inducible antisense vector against a gene in a known proliferation-required pathway, is contacted with a test antibiotic for which it is desired to determine the pathway on which it acts under inducing an non-inducing conditions. If heightened sensitivity is observed in induced cells expressing antisense against a gene in a particular pathway but not in induced cells expressing antisense against genes in other pathways, then the test antibiotic acts against the pathway for which heightened sensitivity was observed.

One skilled in the art will appreciate that further optimization of the assay conditions, such as the concentration of inducer used to induce antisense expression and/or the growth conditions used for the assay (for example incubation temperature and media components) may further increase the selectivity and/or magnitude of the antibiotic sensitization exhibited.

The following example confirms the effectiveness of the methods described above.

Example 11

Identification of the Pathway in which a Proliferation-Required Gene Lies

Antibiotics of various chemical classes and modes of action were purchased from Sigma Chemicals (St. Louis, Mo.). Stock solutions were prepared by dissolving each antibiotic in an appropriate aqueous solution based on information provided by the manufacturer. The final working solution of each antibiotic contained no more than 0.2% (w/v) of any organic solvent. To determine their potency against a bacterial strain engineered for expression of an antisense against a proliferation-required gene encoding 50S ribosomal protein, each antibiotic was serially diluted two or three fold in growth medium supplemented with the appropriate antibiotic for maintenance of the anti-sense construct. At least ten dilutions were prepared for each antibiotic. 25 µL aliquots of each dilution were transferred to discrete wells of a 384-well microplate (the assay plate) using a multi-channel pipette. Quadruplicate wells were used for each dilution of an antibiotic under each treatment condition (plus and minus inducer). Each assay plate contained twenty wells for cell growth controls (growth media replacing antibiotic), ten wells for each treatment (plus and minus inducer, in this example IPTG). Assay plates were usually divided into the two treatments: half the plate containing induced cells and an appropriate concentrations of inducer (in this example IPTG) to maintain the state of induction, the other half containing non-induced cells in the absence of IPTG.

Cells for the assay were prepared as follows. Bacterial cells containing a construct, from which expression of antisense nucleic acid against rpIL and rplJ, which encode proliferation-required 50S ribosomal subunit proteins, is inducible in the presence of IPTG, were grown into exponential growth ($OD_{600}$ 0.2 to 0.3) and then diluted 1:100 into fresh media containing either 400 µM or 0 µM inducer (IPTG). These cultures were incubated at 37° C. for 2.5 hr. After a 2.5 hr incubation, induced and non-induced cells were respectively diluted into an assay medium at a final $OD_{600}$ value of 0.0004. The medium contained an appropriate concentration of the antibiotic for the maintenance of the anti-sense construct. In addition, the medium used to dilute induced cells was supplemented with 800 µM IPTG so that addition to the assay plate would result in a final IPTG concentration of 400 µM. Induced and non-induced cell suspensions were dispensed (25 µl/well) into the appropriate wells of the assay plate as discussed previously. The plate was then loaded into a plate reader, incubated at constant temperature, and cell growth was monitored in each well by the measurement of light scattering at 595 nm. Growth was monitored every 5 minutes until the cell culture attained a stationary growth phase. For each concentration of antibiotic, a percentage inhibition of growth was calculated at the time point corresponding to mid-exponential growth for the associated control wells (no antibiotic, plus or minus IPTG). For each antibiotic and condition (plus or minus IPTG), a plot of percent inhibition versus log of antibiotic concentration was generated and the IC50 determined. A comparison of the $IC_{50}$ for each antibiotic in the presence and absence of IPTG revealed whether induction of the antisense construct sensitized the cell to the mechanism of action exhibited by the antibiotic. Cells which exhibited a significant (standard statistical analysis) numerical decrease in the $IC_{50}$ value in the presence of inducer were considered to have an increased sensitivity to the test antibiotic.

The results are provided in the table below, which lists the classes and names of the antibiotics used in the analysis, the targets of the antibiotics, the IC50 in the absence of IPTG, the IC50 in the presence of IPTG, the concentration units for the IC50s, the fold increase in IC50 in the presence of IPTG, and whether increased sensitivity was observed in the presence of IPTG.

TABLE IV

Effect of Expression of Antisense RNA to rplL and rplJ on Antibiotic Sensitivity

| ANTIBIOTIC CLASS/Names | TARGET | IC50 (−IPTG) | IC50 (+IPTG) | Conc. Unit | Fold Increase in Sensitivity | Sensitivity Increased? |
|---|---|---|---|---|---|---|
| PROTEIN SYNTHESIS INHIBITOR ANTIBIOTICS AMINOGLYCOSIDES | | | | | | |
| Gentamicin | 30S ribosome function | 2715 | 19.19 | ng/ml | 141 | Yes |
| Streptomycin | 30S ribosome function | 11280 | 161 | ng/ml | 70 | Yes |
| Spectinomycin | 30S ribosome function | 18050 | <156 | ng/ml | | Yes |
| Tobramycin | 30S ribosome function | 3594 | 70.53 | ng/ml | 51 | Yes |
| MACROLIDES | | | | | | |
| Erythromycin | 50S ribosome function | 7467 | 187 | ng/ml | 40 | Yes |
| AROMATIC POYKETIDES | | | | | | |
| Tetracycline | 30S ribosome function | 199.7 | 1.83 | ng/ml | 109 | Yes |
| Minocycline | 30S ribosome function | 668.4 | 3.897 | ng/ml | 172 | Yes |
| Doxycycline | 30S ribosome function | 413.1 | 27.81 | ng/ml | 15 | Yes |
| OTHER PROTEIN SYNTHESIS INHIBITORS | | | | | | |
| Fusidic acid | Elongation Factor G function | 59990 | 641 | ng/ml | 94 | Yes |
| Chloramphenicol | 30S ribosome function | 465.4 | 1.516 | ng/ml | 307 | Yes |
| Lincomycin | 50S ribosome function | 47150 | 324.2 | ng/ml | 145 | Yes |
| OTHER ANTIBIOTIC MECHANISMS | | | | | | |
| B-LACTAMS | | | | | | |
| Cefoxitin | Cell wall biosynthesis | 2782 | 2484 | ng/ml | 1 | No |
| Cefotaxime | Cell wall biosynthesis | 24.3 | 24.16 | ng/ml | 1 | No |
| DNA SYNTHESIS INHIBITORS | | | | | | |
| Nalidixic acid | DNA Gyrase activity | 6973 | 6025 | ng/ml | 1 | No |
| Ofloxacin | DNA Gyrase activity | 49.61 | 45.89 | ng/ml | 1 | No |

TABLE IV-continued

Effect of Expression of Antisense RNA to rplL and rplJ on Antibiotic Sensitivity

| ANTIBIOTIC CLASS/Names | TARGET | IC50 (−IPTG) | IC50 (+IPTG) | Conc. Unit | Fold Increase in Sensitivity | Sensitivity Increased? |
|---|---|---|---|---|---|---|
| OTHER | | | | | | |
| Bacitracin | Cell membrane function | 4077 | 4677 | mg/ml | 1 | No |
| Trimethoprim | Dihydrofolate Reductase activity | 128.9 | 131.97 | ng/ml | 1 | No |
| Vancomycin | Cell wall biosynthesis | 145400 | 72550 | ng/ml | 2 | No |

The above results demonstrate that induction of an antisense RNA to genes encoding 50S ribosomal subunit proteins results in a selective and highly significant sensitization of cells to antibiotics that inhibit ribosomal function and protein synthesis. The above results further demonstrate that induction of an antisense construct to an essential gene sensitizes an organism to compounds that interfere with that gene products' biological role. This sensitization is restricted to compounds that interfere with pathways associated with the targeted gene and it's product.

Assays utilizing antisense constructs to essential genes can be used to identify compounds that specifically interfere with the activity of multiple targets in a pathway. Such constructs can be used to simultaneously screen a sample against multiple targets in one pathway in one reaction (Combinatorial HTS).

Furthermore, as discussed above, panels of antisense construct-containing cells may be used to characterize the point of intervention of any compound affecting an essential biological pathway including antibiotics with no known mechanism of action.

Another embodiment of the present invention is a method for determining the pathway against which a test antibiotic compound is active in which the activity of target proteins or nucleic acids involved in proliferation-required pathways is reduced by contacting cells with a sublethal concentration of a known antibiotic which acts against the target protein or nucleic acid. In one embodiment, the target protein or nucleic acid is a target protein or nucleic acid corresponding to a proliferation-required nucleic acid identified using the methods described above. The method is similar to those described above for determining which pathway a test antibiotic acts against except that rather than reducing the activity or level of a proliferation-required gene product using a sublethal level of antisense to a proliferation-required nucleic acid, the activity or level of the proliferation-required gene product is reduced using sublethal level of a known antibiotic which acts against the proliferation required gene product.

Interactions between drugs which affect the same biological pathway has been described in the literature. For example, Mecillinam (Amdinocillin) binds to and inactivates the penicillin binding protein 2 (PBP2, product of the mrdA in E. coli). This antibiotic inteacts with other antibiotics that inhibit PBP2 as well as antibiotics that inhibit other penicillin binding proteins such as PBP3 [(Gutmann, L., Vincent, S., Billot-Klein, D., Acar, J. F., Mrena, E., and Williamson, R. (1986) Involvement of penicillin-binding protein 2 with other penicillin-binding proteins in lysis of Escherichia coli by some beta-lactam antibiotics alone and in synergistic lytic effect of amdinocillin (mecillinam). Antimicrobial Agents & Chemotherapy, 30:906–912), the disclosure of which is incorporated herein by reference in its entirety]. Interactions between drugs could, therefore, involve two drugs that inhibit the same target protein or nucleic acid or inhibit different proteins or nucleic acids in the same pathway [(Fukuoka, T., Domon, H., Kakuta, M., Ishii, C., Hirasawa, A., Utsui, Y., Ohya, S., and Yasuda, H. (1997) Combination effect between panipenem and vancomycin on highly methicillin-resistant Staphylococcus aureus. Japan. J. Antibio. 50:411–419; Smith, C. E., Foleno, B. E., Barrett, J. F., and Frosc, M. B. (1997) Assessment of the synergistic interactions of levofloxacin and ampicillin against Enterococcus faecium by the checkerboard agar dilution and time-kill methods. Diagnos. Microbiol. Infect. Disease 27:85–92; den Hollander, J. G., Horrevorts, A. M., van Goor, M. L., Verbrugh, H. A., and Mouton, J. W. (1997) Synergism between tobramycin and ceftazidime against a resistant Pseudomonas aeruginosa strain, tested in an in vitro pharmacokinetic model. Antimicrobial Agents & Chemotherapy. 41:95–110), the disclosure of all of which are incorporated herein by reference in their entireties].

Two drugs may interact even though they inhibit different targets. For example, the proton pump inhibitor, Omeprazole, and the antibiotic, Amoxycillin, two synergistic compounds acting together, can cure Helicobacter pylori infection [(Gabryelewicz, A., Laszewicz, W., Dzieniszewski, J., Ciok, J., Marlicz, K., Bielecki, D., Popiela, T., Legutko, J., Knapik, Z., Poniewierka, E. (1997) Multicenter evaluation of dual-therapy (omeprazol and amoxycillin) for Helicobacter pylori-associated duodenal and gastric ulcer (two years of the observation). J. Physiol. Pharmacol. 48 Suppl 4:93–105), the disclosure of which is incorporated herein by reference in its entirety].

The growth inhibition from the sublethal concentration of the known antibiotic may be at least about 5%, at least about 8%, at least about 10%, at least about 20%, at least about 30%, at least about 40%, at least about 50%, at least about 60%, or at least about 75%, or more.

Alternatively, the sublethal concentration of the known antibiotic may be determined by measuring the activity of the target proliferation-required gene product rather than by measuring growth inhibition.

Cells are contacted with a combination of each member of a panel of known antibiotics at a sublethal level and varying concentrations of the test antibiotic. As a control, the cells are contacted with varying concentrations of the test antibiotic alone. The $IC_{50}$ of the test antibiotic in the presence and absence of the known antibiotic is determined. If the IC50s in the presence and absence of the known drug are substantially similar, then the test drug and the known drug act on different pathways. If the $IC_{50}$s are substantially different, then the test drug and the known drug act on the same pathway.

Another embodiment of the present invention is a method for identifying a candidate compound for use as an antibiotic in which the activity of target proteins or nucleic acids involved in proliferation-required pathways is reduced by contacting cells with a sublethal concentration of a known antibiotic which acts against the target protein or nucleic acid. In one embodiment, the target protein or nucleic acid is a target protein or nucleic acid corresponding to a proliferation-required nucleic acid identified using the methods described above. The method is similar to those described above for identifying candidate compounds for use as antibiotics except that rather than reducing the activity or level of a proliferation-required gene product using a sublethal level of antisense to a proliferation-required nucleic acid, the activity or level of the proliferation-required gene product is reduced using a sublethal level of a known antibiotic which acts against the proliferation required gene product.

The growth inhibition from the sublethal concentration of the known antibiotic may be at least about 5%, at least about 8%, at least about 10%, at least about 20%, at least about 30%, at least about 40%, at least about 50%, at least about 60%, or at least about 75%, or more.

Alternatively, the sublethal concentration of the known antibiotic may be determined by measuring the activity of the target proliferation-required gene product rather than by measuring growth inhibition.

In order to characterize test compounds of interest, cells are contacted with a panel of known antibiotics at a sublethal level and one or more concentrations of the test compound. As a control, the cells are contacted with the same concentrations of the test compound alone. The $IC_{50}$ of the test compound in the presence and absence of the known antibiotic is determined. If the $IC_{50}$ of the test compound is substantially different in the presence and absence of the known drug then the test compound is a good candidate for use as an antibiotic. As discussed above, once a candidate compound is identified using the above methods its structure may be optimized using standard techniques such as combinatorial chemistry.

Representative known antibiotics which may be used in each of the above methods are provided in the table below. However, it will be appreciated that other antibiotics may also be used.

| ANTIBIOTIC | INHIBITS/TARGET | RESISTANT MUTANTS |
|---|---|---|
| Inhibitors of Transcription | | |
| Rifamycin, 1959 Rifampicin Rifabutin Rifaximin | Inhibits initiation of transcription/β-subunit RNA polymerase, rpoB | rpoB, crp, cyaA |
| Streptolydigin | Accelerates transcription chain termination/β-subunit RNA polymerase | rpoB |
| Streptovaricin | an acyclic ansamycin, inhibits RNA polymerase | rpoB |
| Actinomycin D+EDTA | Intercalates between 2 successive G-C pairs, rpoB, inhibits RNA synthesis | pldA |
| Inhibitors of Nucleic Acid Metabolism | | |
| Quinolones, 1962 Nalidixic acid Oxolinic acid | α subunit gyrase and/or topoisomerase IV, gyrA | gyrA or B, icd, sloB |
| Fluoroquinolones Ciprofloxacin, 1983 Norfloxacin | a subunit gyrase, gyrA and/or topoisomerase IV (probable target in Staph) | gyrA norA (efflux in Staph) hipQ |
| Coumerins Novobiocin | Inhibits ATPase activity of β-subunit gyrase, gyrB | gyrB, cysB, cysE, nov, ompA |
| Coumermycin | Inhibits ATPase activity of β-subunit gyrase, gyrB | gyrB, hisW |
| Albicidin | DNA synthesis | tsx (nucleoside channel) |
| Metronidazole | Causes single-strand breaks in DNA | nar |
| Inhibitors of Metabolic Pathways | | |
| Sulfonamides, 1932 Sulfanilamide | blocks synthesis of dihydrofolate,dihydropteroate synthesis,folP | folP, gpt, pabA, pabB, pabC |
| Trimethoprim, 1962 | Inhibits dihydrofolate reductase,folA | folA, thyA |
| Showdomycin | Nucleoside analogue capable of alkylating sulfhydryl groups, inhibitor of thymidylate synthetase | nupC, pnp |
| Thiolactomycin | type II fatty acid synthase inhibitor | emrB fadB, emrB due to gene dosage |
| Psicofuranine | Adenosine glycoside antibiotic, target is GMP synthetase | guaA,B |
| Triclosan | Inhibits fatty acid synthesis | fabI (envM) |
| Diazoborines Isoniazid, Ethionamide | heterocyclic, contains boron, inhibit fatty acid synthesis, enoyl-ACP reductase,fabI | fabI (envM) |
| Inhibitors of Translation | | |
| Phenylpropanoids Chloramphenicol, 1947 | Binds to ribosomal peptidyl transfer center preventing peptide translocation/binds to S6, L3, L6, L14, L16, L25, L26, L27, but preferentially to L16 | rrn, cmlA, marA, ompF, ompR |
| Tetracyclines, 1948, type II polyketides | Binding to 30S ribosomal subunit, "A" site on 30S subunit, blocks peptide elongation, | clmA (cmr), mar, ompF |

-continued

| ANTIBIOTIC | INHIBITS/TARGET | RESISTANT MUTANTS |
|---|---|---|
| Minocycline | strongest binding to S7 | |
| Doxycycline | | |
| Macrolides (type I polyketides) | Binding to 50 S ribosomal subunit, 23S | |
| Erythromycin, 1950 | rRNA, blocks peptide translocation, L15, | |
| Carbomycin, Spiramycin | L4, L12 | rrn, rplC, rplD, rplV, mac |
| etc | | |
| Aminoglycosides Streptomycin, 1944 | Irreversible binding to 30S ribosomal subunit, prevents translation or causes | rpsL,strC,M,ubiF |
| Neomycin | mistranslation of mRNA/16S rRNA | atpA-E,ecfB, hemAC,D,E,G,topA, rpsCD,E,rrn,spcB |
| Spectinomycin | | atpA-atpE,cpxA,ecfB, |
| Kanamycin | | hemA,B,L,topA ksgA,B,C,D,rplB,K, rpsl,N,M,R |
| Kasugamycin | | rplF,ubiF |
| Gentamicin, 1963 | | cpxA |
| Amikacin | | rpsL |
| Paromycin | | |
| Lincosamides | Binding to 50 S ribosomal subunit, blocks | |
| Lincomycin, 1955 | peptide translocation | linB, rplN, O, rpsG |
| Clindamycin | | |
| Streptogramins Virginiamycin, 1955 Pristinamycin | 2 components, Streptogramins A&B, bind to the 50S ribosomal subunit blocking | |
| Synercid: quinupristin/ dalfopristin | peptide translocation and peptide bond formation | |
| Fusidanes | Inhibition of elongation factor G (EF-G) | fusA |
| Fusidic Acid | prevents peptide translocation | |
| Kirromycin (Mocimycin) | Inhibition of elongation factor TU (EF-Tu), prevents peptide bond formation | tufA,B |
| Pulvomycin | Binds to and inhibits EF-TU | |
| Thiopeptin | Sulfur-containing antibiotic, inhibits protein synthesis,EF-G | rplE |
| Tiamulin | Inhibits protein synthesis | rplC, rplD |
| Negamycin | Inhibits termination process of protein synthesis | prfB |
| Oxazolidinones Linezolid | 23S rRNA | |
| Isoniazid | | |
| | | pdx |
| Nitrofurantoin | Inhibits protein synthesis, nitroreductases convert nitrofurantoin to highly reactive electrophilic intermediates which attack bacterial ribosomal proteins non-specifically | nfnA,B |
| Pseudomonic Acids Mupirocin (Bactroban) | Inhibition of isoleucyl tRNA synthetase-used for Staph, topical cream, nasal spray | ileS |
| Indolmycin | Inhibits tryptophanyl-tRNA synthetase | trpS |
| Viomycin | | rrmA (23S rRNA methyltransferase; mutant has slow growth rate, slow chain elongation rate, and viomycin resistance) |
| Thiopeptides | Binds to L11-23S RNA complex | |
| Thiostrepton | Inhibits GTP hydrolysis by EF-G | |
| Micrococcin | Stimulates GTP hydrolysis by EF-G | |
| Inhibitors of Cell Walls/Membranes | | |
| β-lactams | Inhibition of one or more cell wall | |
| Penicillin, 1929 Ampicillin | transpeptidases, endopeptidases, and | |
| Methicillin, 1960 | glycosidases (PBPs), of the 12 PBPs only 2 are essential: mrdA (PBP2) and ftsI (pbpB, PBP3) | ampC, ampD, ampE, envZ, galU, hipA, hipQ, ompC, ompF, ompR, ptsI, rfa, tolD, tolE |
| Cephalosporins, 1962 | | tonB |
| Mecillinam (amdinocillin) | Binds to and inactivates PBP2 (mrdA) | alaS, argS, crp, cyaA, |
| | Inactivates PBP3 (ftsI) | envB, mrdA,B, |
| Aztreonam (Furazlocillin) | | mreB,C,D |
| Bacilysin, Tetaine | Dipeptide, inhib glucosamine synthase | dppA |
| Glycopeptides Vancomycin, 1955 | Inhib G+ cell wall syn, binds to terminal D-ala-D-ala of pentapeptide, | |

-continued

| ANTIBIOTIC | INHIBITS/TARGET | RESISTANT MUTANTS |
|---|---|---|
| Polypeptides Bacitracin | Prevents dephosphorylation and regeneration of lipid carrier | rfa |
| Cyclic lipopeptide Daptomycin, 1980 | Disrupts multiple aspects of membrane function, including peptidoglycan synthesis, lipoteichoic acid synthesis, and the bacterial membrane potential | |
| Cyclic polypeptides Polymixin, 1939 | Surfactant action disrupts cell membrane lipids, binds lipid A mioety of LPS | pmrA |
| Fosfomycin, 1969 | Analogue of P-enolpyruvate, inhibits 1st step in peptidoglycan synthesis-UDP-N-acetylglucosamine enolpyruvyl transferase, murA. Also acts as Immunosuppressant | murA, crp, cyaA glpT; hipA, ptsl, uhpT |
| Cycloserine | Prevents formation of D-ala dimer, inhibits D-ala ligase,ddlA,B | hipA, cycA |
| Alafosfalin | phosphonodipeptide, cell wall synthesis inhibitor, potentiator of β-lactams | pepA, tpp |
| Inhibitors of Protein Processing/Transport | | |
| Globomycin | Inhibits signal peptidase II (cleaves prolipoproteins subsequent to lipid modification, lspA | lpp, dnaE |

Example 12

Transfer of Exogenous Nucleic Acid Sequences to Other Bacterial Species Using the *E. coli* Expression Vectors or Expression Vectors Functional in Bacterial Species other than *E. coli*

Molecule No. EcXA059, encoding a portion of the ypjA gene of *Escherichia coli*, was either transformed directly into *Enterobacter cloacae, Salmonella typhimurium* and/or *Klebsiella pneumoniae* or subcloned into an expression vector functional in these species and the subclones transformed into these organisms. Suitable expression vectors are well known in the art. These expression vectors were introduced into *Enterobacter cloacae, Salmonella typhimurium* and/or *Klebsiella pneumoniae* cells that were then assayed for growth inhibition according to the method of Example 1. After growth in liquid culture, cells were plated at various serial dilutions and a score determined by calculating the log difference in growth for INDUCED vs. UNINDUCED antisense RNA expression as determined by the maximum 10 fold dilution at which a colony was observed. If there was no effect of antisense RNA expression in one organism, the clone is given a score of zero "0" in that organism. In contrast, a score of "8" means that $10^8$ times more cells were required to observe a colony formed on the induced state than in the non-induced state under the conditions used and in that organism.

Expression vectors containing Molecule No. EcXA059 were found to inhibit bacterial growth in all four organisms when expression of the antisense RNA was induced with IPTG. A score of 8 was assigned for *Escherichia coli, Enterobacter cloacae*, and *Salmonella typhimurium* and in *Klebsiella pneumoniae* the score was >7. The protein encoded by this sequence is used as a target sequence to screen candidate compound libraries as described above.

In addition, the above methods were validated using other antisense nucleic acids which inhibit the growth of *E. coli* which were identified using methods similar to those described above. Expression vectors which inhibited growth of *E. coli* upon induction of antisense RNA expression with IPTG were transformed directly into *Enterobacter cloacae,* *Klebsiella pneumonia* or *Salmonella typhimurium*. The transformed cells were then assayed for growth inhibition according to the method of Example 1. After growth in liquid culture, cells were plated at various serial dilutions and a score determined by calculating the log difference in growth for INDUCED vs. UNINDUCED antisense RNA expression as determined by the maximum 10 fold dilution at which a colony was observed. The results of these experiments are listed in Table V below. If there was no effect of antisense RNA expression in a microorganism, the clone is minus in Table V below. In contrast, a positive in Table V below means that at least 10 fold more cells were required to observe a colony on the induced plate than on the non-induced plate under the conditions used and in that microorganism.

Sixteen of the constructs were found to inhibit growth in all the microorganisms tested upon induction of antisense RNA expression with IPTG.

TABLE V

Sensitivity of Other Microorganisms to Antisense Nucleic Acids That Inhibit Proliferation in *E. coli*

| Mol. No. | *S. typhimurium* | *E. cloacae* | *K. pneumoniae* |
|---|---|---|---|
| EcXA001 | + | + | − |
| EcXA004 | + | − | − |
| EcXA005 | + | + | + |
| EcXA006 | − | − | − |
| EcXA007 | − | + | − |
| EcXA008 | + | − | + |
| EcXA009 | − | − | − |
| EcXA010 | + | + | + |
| EcXA011 | − | + | − |
| EcXA012 | − | + | − |
| EcXA013 | + | + | + |
| EcXA014 | + | + | − |
| EcXA015 | + | + | + |
| EcXA016 | + | + | + |
| EcXA017 | + | + | + |
| EcXA018 | + | + | + |
| EcXA019 | + | + | + |
| EcXA020 | + | + | + |
| EcXA021 | + | + | + |

TABLE V-continued

Sensitivity of Other Microorganisms to Antisense Nucleic Acids That Inhibit Proliferation in *E. coli*

| Mol. No. | *S. typhimurium* | *E. cloacae* | *K. pneumoniae* |
|---|---|---|---|
| EcXA023 | + | + | + |
| EcXA024 | + | − | + |
| EcXA025 | − | − | − |
| EcXA026 | + | + | − |
| EcXA027 | + | + | − |
| EcXA028 | + | − | − |
| EcXA029 | − | − | − |
| EcXA030 | + | + | + |
| EcXA031 | + | − | − |
| EcXA032 | + | + | − |
| EcXA033 | + | + | + |
| EcXA034 | + | + | + |
| EcXA035 | − | − | − |
| EcXA036 | + | − | + |
| EcXA037 | + | + | − |
| EcXA038 | + | + | + |
| EcXA039 | + | − | − |
| EcXA041 | + | + | + |
| EcXA042 | − | + | + |
| EcXA043 | − | − | − |
| EcXA044 | − | − | − |
| EcXA045 | + | + | + |
| EcXA046 | − | − | − |
| EcXA047 | + | + | − |
| EcXA048 | − | − | − |
| EcXA049 | + | − | − |
| EcXA050 | − | − | − |
| EcXA051 | + | − | − |
| EcXA052 | + | − | − |
| EcXA053 | + | + | + |
| EcXA054 | − | − | + |
| EcXA055 | + | − | − |
| EcXA056 | + | − | + |
| EcXA057 | + | + | − |
| EcXA058 | − | − | − |
| EcXA059 | + | + | + |
| EcXA060 | − | − | − |
| EcXA061 | − | − | − |
| EcXA062 | − | − | − |
| EcXA063 | + | + | − |
| EcXA064 | − | − | − |
| EcXA065 | + | + | − |
| EcXA066 | − | − | − |
| EcXA067 | − | + | − |
| EcXA068 | − | − | − |
| FcXA069 | − | + | − |
| EcXA070 | − | − | − |
| EcXA071 | + | − | − |
| EcXA072 | + | − | + |
| EcXA073 | + | + | + |
| EcXA074 | + | + | + |
| EcXA075 | + | − | − |
| EcXA076 | − | + | − |
| EcXA077 | + | + | − |
| EcXA079 | + | + | + |
| EcXA080 | + | − | − |
| EcXA082 | − | + | − |
| EcXA083 | − | − | − |
| EcXA084 | − | + | − |
| EcXA086 | − | − | − |
| EcXA087 | − | − | − |
| EcXA088 | − | − | − |
| EcXA089 | − | − | − |
| EcXA090 | − | − | − |
| EcXA091 | − | − | − |
| EcXA092 | − | − | − |
| EcXA093 | − | − | − |
| EcXA094 | + | + | + |
| EcXA095 | + | + | − |
| EcXA096 | − | − | − |
| EcXA097 | + | − | − |
| EcXA098 | + | − | − |
| EcXA099 | − | − | − |
| EcXA100 | − | − | − |
| EcXA101 | − | − | − |
| EcXA102 | − | − | − |
| EcXA103 | − | + | − |
| EcXA104 | + | + | + |
| EcXA106 | + | + | − |
| EcXA107 | − | − | − |
| EcXA108 | − | − | − |
| EcXA109 | − | − | − |
| EcXA110 | + | + | − |
| EcXA111 | − | − | − |
| EcXA112 | − | + | − |
| EcXA113 | + | + | + |
| EcXA114 | − | + | − |
| EcXA115 | − | + | − |
| EcXA116 | + | + | − |
| EcXA117 | + | − | − |
| EcXA118 | − | − | − |
| EcXA119 | + | + | − |
| EcXA120 | − | − | − |
| EcXA121 | − | − | − |
| EcXA122 | + | − | + |
| EcXA123 | + | − | − |
| EcXA124 | − | − | − |
| EcXA125 | − | − | − |
| EcXA126 | − | − | − |
| EcXA127 | + | + | − |
| EcXA128 | − | − | − |
| EcXA129 | − | + | − |
| EcXA130 | + | + | − |
| EcXA132 | − | − | − |
| EcXA133 | − | − | − |
| EcXA136 | − | − | − |
| EcXA137 | − | − | − |
| EcXA138 | + | − | − |
| EcXA139 | − | − | − |
| EcXA140 | + | − | − |
| EcXA141 | + | − | − |
| EcXA142 | − | − | − |
| EcXA143 | − | + | − |
| EcXA144 | + | + | − |
| EcXA145 | − | − | − |
| EcXA146 | − | − | − |
| EcXA147 | − | − | − |
| EcXA148 | − | − | − |
| EcXA149 | + | + | + |
| EcXA150 | − | − | − |
| EcXA151 | + | − | − |
| EcXA152 | − | − | − |
| EcXA153 | + | + | − |
| ECXA154 | − | − | − |
| EcXA155 | − | − | ND |
| EcXA156 | − | + | − |
| EcXA157 | − | − | − |
| EcXA158 | − | − | − |
| EcXA159 | + | − | − |
| EcXA160 | + | − | − |
| EcXA162 | − | − | − |
| EcXA163 | − | − | − |
| EcXA164 | − | − | − |
| EcXA165 | − | − | − |
| EcXA166 | − | − | − |
| EcXA167 | − | − | − |
| EcXA168 | − | − | − |
| EcXA169 | − | + | − |
| EcXA171 | − | − | − |
| BcXA172 | − | − | − |
| ECXA173 | − | − | − |
| EcXA174 | − | − | − |
| EcXA175 | − | − | − |
| EcXA176 | − | − | − |
| EcXA178 | − | − | − |
| EcXA179 | − | − | − |
| EcXA180 | + | − | − |
| EcXA181 | − | − | − |

TABLE V-continued

Sensitivity of Other Microorganisms to Antisense Nucleic Acids That Inhibit Proliferation in *E. coli*

| Mol. No. | S. typhimurium | E. cloacae | K. pneumoniae |
|---|---|---|---|
| EcXA182 | − | − | − |
| EcXA183 | − | − | − |
| EcXA184 | − | − | − |
| EcXA185 | − | − | − |
| EcXA186 | − | − | − |
| EcXA187 | + | + | + |
| EcXA189 | + | − | − |
| EcXA190 | + | + | + |
| ECXA191 | + | + | − |
| EcXA192 | − | + | − |

Thus, the ability of an antisense nucleic acid which inhibits the proliferation of *E. coli* to inhibit the growth of other organims may be evaluated by either transforming the antisense nucleic acid directly into other Escherichia species or inserting the antisense nucleic acid into expression vectors that are functional in other Gram negative species such as *Enterobacter cloacae, Salmonella typhimurium*, and/or *Klebsiella pneumoniae*. Similarly, the antisense nucleic acid can be inserted in expression vectors that are functional in Gram-positive species such as *Staphylococcus aureus, Enterococcus faecalis* and *Streptococcus pneumoniae* or other species.

Those skilled in the art will appreciate that a negative result in a heterologous microorganism does not mean that that microorganism is missing that gene nor does it mean that the gene is unessential. However, a positive result means that the heterologous microorganism contains a homologous gene which is required for proliferation of that microorganism. The homologous gene may be obtained using the methods described herein. Those cells that are inhibited by antisense may be used in cell based assays as described herein for the identification and characterization of compounds in order to develop antibiotics effective in these microorganisms. Those skilled in the art will appreciate that an antisense molecule which works in the microorganism from which it was obtained will not always work in a heterologous microorganism.

Example 13

Use of Identified Exogenous Nucleic Acid Sequences as Probes

The identified sequence of the present invention can be used as probes to obtain the sequence of additional genes of interest from a second organism. For example, probes to potential bacterial target proteins may be hybridized to nucleic acids from other organisms including other bacteria and higher organisms, to identify homologous sequences. Such hybridization might indicate that the protein encoded by the gene to which the probe corresponds is found in humans and therefore not necessarily a good drug target. Alternatively, the gene can be conserved only in bacteria and therefore would be a good drug target for a broad spectrum antibiotic or antimicrobial.

Probes derived from the identified nucleic acid sequences of interest or portions thereof can be labeled with detectable labels familiar to those skilled in the art, including radioisotopes and non-radioactive labels, to provide a detectable probe. The detectable probe can be single stranded or double stranded and can be made using techniques known in the art, including in vitro transcription, nick translation, or kinase reactions. A nucleic acid sample containing a sequence capable of hybridizing to the labeled probe is contacted with the labeled probe. If the nucleic acid in the sample is double stranded, it can be denatured prior to contacting the probe. In some applications, the nucleic acid sample can be immobilized on a surface such as a nitrocellulose or nylon membrane. The nucleic acid sample can comprise nucleic acids obtained from a variety of sources, including genomic DNA, cDNA libraries, RNA, or tissue samples.

Procedures used to detect the presence of nucleic acids capable of hybridizing to the detectable probe include well known techniques such as Southern blotting, Northern blotting, dot blotting, colony hybridization, and plaque hybridization. In some applications, the nucleic acid capable of hybridizing to the labeled probe can be cloned into vectors such as expression vectors, sequencing vectors, or in vitro transcription vectors to facilitate the characterization and expression of the hybridizing nucleic acids in the sample. For example, such techniques can be used to isolate, purify and clone sequences from a genomic library, made from a variety of bacterial species, which are capable of hybridizing to probes made from the sequences identified in Examples 5 and 6.

Example 14

Preparation of PCR Primers and Amplification of DNA

The identified *E. coli* genes corresponding directly to or located within the operon of nucleic acid sequences required for proliferation or portions thereof can be used to prepare PCR primers for a variety of applications, including the identification or isolation of homologous sequences from other species, for example *S. typhimurium, E. cloacae*, and *Klebsiella pneumoniae*, which contain part or all of the homologous genes. Because homologous genes are related but not identical in sequence, those skilled in the art will often employ degenerate sequence PCR primers. Such degenerate sequence primers are designed based on conserved sequence regions, either known or suspected, such as conserved coding regions. The successful production of a PCR product using degenerate probes generated from the sequences identified herein would indicate the presence of a homologous gene sequence in the species being screened. The PCR primers are at least 10 bases, and preferably at least 20 bases in length. More preferably, the PCR primers are at least 20–30 bases in length. In some embodiments, the PCR primers can be more than 30 bases in length. It is preferred that the primer pairs have approximately the same G/C ratio, so that melting temperatures are approximately the same. A variety of PCR techniques are familiar to those skilled in the art. For a review of PCR technology, see Molecular Cloning to Genetic Engineering White, B. A. Ed. in Methods in Molecular Biology 67: Humana Press, Totowa 1997. When the entire coding sequence of the target gene is known, the 5' and 3' regions of the target gene can be used as the sequence source for PCR probe generation. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension

Example 15

Inverse PCR

The technique of inverse polymerase chain reaction can be used to extend the known nucleic acid sequence identified in Examples 5 and 6. The inverse PCR reaction is described generally by Ochman et al., in Ch. 10 of PCR Technology: Principles and Applications for DNA Amplification, (Henry A. Erlich, Ed.) W. H. Freeman and Co. (1992). Traditional PCR requires two primers that are used to prime the synthesis of complementary strands of DNA. In inverse PCR, only a core sequence need be known.

Using the sequences identified as relevant from the techniques taught in Examples 5 and 6 and applied to other species of bacteria, a subset of exogenous nucleic sequences are identified that correspond to genes or operons that are required for bacterial proliferation. In species for which a genome sequence is not known, the technique of inverse PCR provides a method for obtaining the gene in order to determine the sequence or to place the probe sequences in full context to the target sequence to which the identified exogenous nucleic acid sequence binds.

To practice this technique, the genome of the target organism is digested with an appropriate restriction enzyme so as to create fragments of nucleic acid that contain the identified sequence as well as unknown sequences that flank the identified sequence. These fragments are then circularized and become the template for the PCR reaction. PCR primers are designed in accordance with the teachings of Example 15 and directed to the ends of the identified sequence are synthesized. The primers direct nucleic acid synthesis away from the known sequence and toward the unknown sequence contained within the circularized template. After the PCR reaction is complete, the resulting PCR products can be sequenced so as to extend the sequence of the identified gene past the core sequence of the identified exogenous nucleic acid sequence identified. In this manner, the full sequence of each novel gene can be identified. Additionally the sequences of adjacent coding and noncoding regions can be identified.

Example 16

Identification of Genes Required for *Staphylococcus aureus* Proliferation

Genes required for proliferation in *Staphylococcus aureus* are identified according to the methods described above.

Example 17

Identification of Genes Required for *Neisseria gonorrhoeae* Proliferation

Genes required for proliferation in *Neisseria gonorrhoeae* are identified according to the methods described above.

Example 18

Identification of Genes Required for *Pseudomonas aeruginosa* Proliferation Genes required for proliferation in *Pseudomonas aeruginosa* are identified according to the methods described above.

Example 19

Identification of Genes Required for *Enterococcus faecalis* Proliferation

Genes required for proliferation in *Enterococcus faecalis* are identified according to the methods described above.

Example 20

Identification of Genes Required for *Haemophilus influenzae* Proliferation Genes required for proliferation in *Haemophilus influenzae* are identified according to the methods described above.

Example 21

Identification of Genes Required for *Salmonella typhimurium* Proliferation Genes required for proliferation in *Salmonella typhimurium* are identified according to the methods described above.

Example 22

Identification of Genes Required for *Helicobacter pylori* Proliferation

Genes required for proliferation in *Helicobacter pylori* are identified according to the methods described above.

Example 23

Identification of Genes Required for *Mycoplasma pneumoniae* Proliferation

Genes required for proliferation in *Mycoplasma pneumoniae* are identified according to the methods described above.

Example 24

Identification of Genes Required for *Plasmodium ovale* Proliferation

Genes required for proliferation in *Plasmodium ovale* are identified according to the methods described above.

Example 25

Identification of Genes Required for *Saccharomyces cerevisiae* Proliferation Genes required for proliferation in *Saccharomyces cerevisiae* are identified according to the methods described above.

Example 26

Identification of Genes Required for *Entamoeba histolytica* Proliferation

Genes required for proliferation in *Entamoeba histolytica* are identified according to the methods described above.

Example 27

Identification of Genes Required for *Candida albicans* Proliferation

Genes required for proliferation in *Candida albicans* are identified according to the methods described above.

Example 28

**Identification of Genes Required for *Klebsiella pneumoniae* Proliferation**

Genes required for proliferation in *Klebsiella pneumoniae* are identified according to the methods described above.

Example 29

**Identification of Genes Required for *Salmonella typhi* Proliferation**

Genes required for proliferation in *Salmonella typhi* are identified according to the methods described above.

Example 30

**Identification of Genes Required for *Salmonella paratyphi* Proliferation**

Genes required for proliferation in *Salmonella paratyphi* are identified according to the methods described above.

Example 31

**Identification of Genes Required for *Salmonella cholerasuis* Proliferation**

Genes required for proliferation in *Salmonella cholerasuis* are identified according to the methods described above.

Example 32

**Identification of Genes Required for *Staphylococcus epidermis* Proliferation**

Genes required for proliferation in *Staphylococcus epidermis* are identified according to the methods described above.

Example 33

**Identification of Genes Required for *Mycobacterium tuberculosis* Proliferation**

Genes required for proliferation in *Mycobacterium tuberculosis* are identified according to the methods described above.

Example 34

**Identification of Genes Required for *Mycobacterium leprae* Proliferation**

Genes required for proliferation in *Mycobacterium leprae* are identified according to the methods described above.

Example 35

**Identification of Genes Required for *Treponema pallidum* Proliferation**

Genes required for proliferation in *Treponema pallidum* are identified according to the methods described above.

Example 36

**Identification of Genes Required for *Bacillus anthracis* Proliferation**

Genes required for proliferation in *Bacillus anthracis* are identified according to the methods described above.

Example 37

**Identification of Genes Required for *Yersinia pestis* Proliferation**

Genes required for proliferation in *Yersinia pestis* are identified according to the methods described above.

Example 38

**Identification of Genes Required for *Clostridium botulinum* Proliferation**

Genes required for proliferation in *Clostridium botulinum* are identified according to the methods described above.

Example 39

**Identification of Genes Required for *Campvlobacter jejuni* Proliferation**

Genes required for proliferation in *Campylobacter jejuni* are identified according to the methods described above.

Example 40

**Identification of Genes Required for *Chlamydia trachomatis* Proliferation**

Genes required for proliferation in *Chlamydia trachomatis* are identified according to the methods described above.

Use of Isolated Exogenous Nucleic Acid Fragments as Antisense Antibiotics

In addition to using the identified sequences to enable screening of molecule libraries to identify compounds useful to identify antibiotics, the sequences themselves can be used as therapeutic agents. Specifically, the identified exogenous sequences in an antisense orientation can be provided to an individual to inhibit the translation of a bacterial target gene.

Generation of Antisense Therapeutics from Identified Exogenous Sequences

The sequences of the present invention can be used as antisense therapeutics for the treatment of bacterial infections or simply for inhibition of bacterial growth in vitro or in vivo. The therapy exploits the biological process in cells where genes are transcribed into messenger RNA (mRNA) that is then translated into proteins. Antisense RNA technology contemplates the use of antisense oligonucleotides directed against a target gene that will bind to its target and decrease or inhibit the translation of the target mRNA. In one embodiment, antisense oligonucleotides can be used to treat and control a bacterial infection of a cell culture containing a population of desired cells contaminated with bacteria. In another embodiment, the antisense oligonucleotides can be used to treat an organism with a bacterial infection.

Antisense oligonucleotides can be synthesized from any of the sequences of the present invention using methods well known in the art. In a preferred embodiment, antisense oligonucleotides are synthesized using artificial means. Uhlmann & Peymann, Chemical Rev. 90:543–584 (1990) review antisense oligonucleotide technology in detail. Modified or unmodified antisense oligonucleotides can be used as therapeutic agents. Modified antisense oligonucleotides are preferred since it is well known that antisense oligonucleotides are extremely unstable. Modification of the phosphate backbones of the antisense oligonucleotides can be achieved by substituting the internucleotide phosphate residues with methylphosphonates, phosphorothioates, phosphoramidates, and phosphate esters. Nonphosphate internucleotide analogs such as siloxane bridges, carbonate brides, thioester bridges, as well as many others known in the art. The preparation of certain antisense oligonucleotides with modified internucleotide linkages is described in U.S. Pat. No. 5,142,047, hereby incorporated by reference.

Modifications to the nucleoside units of the antisense oligonucleotides are also contemplated. These modifications can increase the half-life and increase cellular rates of uptake for the oligonucleotides in vivo. For example, α-anomeric nucleotide units and modified bases such as 1,2-dideoxy-d-ribofuranose, 1,2-dideoxy-1-phenylribofuranose, and $N^4$, $N^4$-ethano-5-methyl-cytosine are contemplated for use in the present invention.

An additional form of modified antisense molecules is found in peptide nucleic acids. Peptide nucleic acids (PNA) have been developed to hybridize to single and double stranded nucleic acids. PNA are nucleic acid analogs in which the entire deoxyribose-phosphate backbone has been exchanged with a chemically completely different, but structurally homologous, polyamide (peptide) backbone containing 2-aminoethyl glycine units. Unlike DNA, which is highly negatively charged, the PNA backbone is neutral. Therefore, there is much less repulsive energy between complementary strands in a PNA-DNA hybrid than in the comparable DNA-DNA hybrid, and consequently they are much more stable. PNA can hybridize to DNA in either a Watson/Crick or Hoogsteen fashion (Demidov et al., *Proc. Natl. Acad Sci. USA*. 92:2637–2641, 1995; Egholm, *Nature* 365:566–568, 1993; Nielsen et al., *Science* 254:1497–1500, 1991; Dueholm et al., *New J. Chem.* 21:19–31, 1997).

Molecules called PNA "clamps" have been synthesized which have two identical PNA sequences joined by a flexible hairpin linker containing three 8-amino-3,6-dioxaoctanoic acid units. When a PNA clamp is mixed with a complementary homopurine or homopyrimidine DNA target sequence, a PNA-DNA-PNA triplex hybrid can form which has been shown to be extremely stable (Bentin et al., *Biochemistry* 35:8863–8869, 1996; Egholm et al., *Nucleic Acids Res.* 23:217–222, 1995; Griffith et al., *J. Am. Chem. Soc.* 117:831–832, 1995).

The sequence-specific and high affinity duplex and triplex binding of PNA have been extensively described (Nielsen et al., *Science* 254:1497–1500, 1991; Egholm et al., *J. Am. Chem. Soc.* 114:9677–9678, 1992; Egholm et al., *Nature* 365:566–568, 1993; Almarsson et al., *Proc. Natl. Acad Sci. USA*. 90:9542–9546, 1993; Demidov et al., *Proc. Natl. Acad. Sci. U.S.A*. 92:2637–2641, 1995). They have also been shown to be resistant to nuclease and protease digestion (Demidov et al., *Biochem. Pharm.* 48:1010–1313, 1994). PNA has been used to inhibit gene expression (Hanvey et al., *Science* 258:1481–1485,1992; Nielsen et al., *Nucl. Acids. Res.*, 21:197–200, 1993; Nielsen et al., *Gene* 149:139–145, 1994; Good & Nielsen, Science, 95: 2073–2076, 1998; all of which are hereby incorporated by reference), to block restriction enzyme activity (Nielsen et al., supra., 1993), to act as an artificial transcription promoter (Mollegaard, *Proc. Natl. Acad. Sci. U.S.A*. 91:3892–3895, 1994) and as a pseudo restriction endonuclease (Demidov et al., *Nucl. Acids. Res.* 21:2103–2107, 1993). Recently, PNA has also been shown to have antiviral and antitumoral activity mediated through an antisense mechanism (Norton, *Nature Biotechnol.*, 14:615–619, 1996; Hirschman et al., *J. Investig. Med.* 44:347–351, 1996). PNAs have been linked to various peptides in order to promote PNA entry into cells (Basu et al., *Bioconj. Chem.* 8:481–488, 1997; Pardridge et al., *Proc. Natl. Acad. Sci. U.S.A*. 92:5592–5596, 1995).

The antisense oligonucleotides contemplated by the present invention can be administered by direct application of oligonucleotides to a target using standard techniques well known in the art. The antisense oligonucleotides can be generated within the target using a plasmid, or a phage. Alternatively, the antisense nucleic acid may be expressed from a sequence in the chromosome of the target cell. It is further contemplated that contemplated that the antisense oligonucleotide contemplated are incorporated in a ribozyme sequence to enable the antisense to specifically bind and cleave its target mRNA. For technical applications of ribozyme and antisense oligonucleotides see Rossi et al., Pharmacol. Ther. 50(2):245–254, (1991), which is hereby incorporated by reference. The present invention also contemplates using a retron to introduce an antisense oligonucleotide to a cell. Retron technology is exemplified by U.S. Pat. No. 5,405,775, which is hereby incorporated by reference. Antisense oligonucleotides can also be delivered using liposomes or by electroporation techniques which are well known in the art.

The antisense nucleic acids of the present invention can also be used to design antibiotic compounds comprising nucleic acids which function by intracellular triple helix formation. Triple helix oligonucleotides are used to inhibit transcription from a genome. The sequences identified as required for proliferation in the present invention, or portions thereof, can be used as templates to inhibit microorganism gene expression in individuals infected with such organisms. Traditionally, homopurine sequences were considered the most useful for triple helix strategies. However, homopyrimidine sequences can also inhibit gene expression. Such homopyrimidine oligonucleotides bind to the major groove at homopurine:homopyrimidine sequences. Thus, both types of sequences based on the sequences of the present invention that are required for proliferation are contemplated for use as antibiotic compound templates.

The antisense oligonucleotides of this example employ the identified sequences of the present invention to induce bacterial cell death or at least bacterial stasis by inhibiting target gene translation. Antisense oligonucleotides containing from about 8 to 40 bases of the sequences of the present invention have sufficient complementary to form a duplex with the target sequence under physiological conditions.

To kill bacterial cells or inhibit their growth, the antisense oligonucleotides are applied to the bacteria or to the target cells under conditions that facilitate their uptake. These conditions include sufficient incubation times of cells and oligonucleotides so that the antisense oligonucleotides are taken up by the cells. In one embodiment, an incubation period of 7–10 days is sufficient to kill bacteria in a sample. An optimum concentration of antisense oligonucleotides is selected for use.

The concentration of antisense oligonucleotides to be used can vary depending on the type of bacteria sought to be controlled, the nature of the antisense oligonucleotide to be used, and the relative toxicity of the antisense oligonucleotide to the desired cells in the treated culture. Antisense oligonucleotides can be introduced to cell samples at a number of different concentrations preferably between $1 \times 10^{-10}$M to $1 \times 10^{-4}$M. Once the minimum concentration that can adequately control gene expression is identified, the optimized dose is translated into a dosage suitable for use in vivo. For example, an inhibiting concentration in culture of $1 \times 10^{-7}$ translates into a dose of approximately 0.6 mg/kg body weight. Levels of oligonucleotide approaching 100 mg/kg body weight or higher may be possible after testing the toxicity of the oligonucleotide in laboratory animals. It is additionally contemplated that cells from the subject are removed, treated with the antisense oligonucleotide, and reintroduced into the subject. This range is merely illustrative and one of skill in the art are able to determine the optimal concentration to be used in a given case.

After the bacterial cells have been killed or controlled in a desired culture, the desired cell population may be used for other purposes.

Example 41

The following example demonstrates the ability of an E. coli antisense oligonucleotide to act as a bactericidal or bacteriostatic agent to treat a contaminated cell culture system. The application of the antisense oligonucleotides of the present invention are thought to inhibit the translation of bacterial gene products required for proliferation.

The antisense oligonucleotide of this example corresponds to a 30 base phophorothioate modified oligodeoxynucelotide complementary to a nucleic acid involved in proliferation, such as Molecule Number EcXA056 (SEQ ID NO: 1). A sense oligodeoxynucelotide complementary to the antisense sequence is synthesized and used as a control. The oligonucleotides are synthesized and purified according to the procedures of Matsukura, et al., Gene 72:343 (1988). The test oligonucleotides are dissolved in a small volume of autoclaved water and added to culture medium to make a 100 micromolar stock solution.

Human bone marrow cells are obtained from the peripheral blood of two patients and cultured according standard procedures well known in the art. The culture is contaminated with the K-12 strain of E. coli and incubated at 37° C. overnight to establish bacterial infection.

The control and antisense oligonucleotide containing solutions are added to the contaminated cultures and monitored for bacterial growth. After a 10 hour incubation of culture and oligonucleotides, samples from the control and experimental cultures are drawn and analyzed for the translation of the target bacterial gene using standard microbiological techniques well known in the art. The target E. coli gene is found to be translated in the control culture treated with the control oligonucleotide, however, translation of the target gene in the experimental culture treated with the antisense oligonucleotide of the present invention is not detected or reduced.

Example 42

A subject suffering from an E. coli infection is treated with the antisense oligonucleotide preparation of Example 39. The antisense oligonucleotide is provided in a pharmaceutically acceptable carrier at a concentration effective to inhibit the translation of the target gene. The present subject is treated with a concentration of antisense oligonucleotide sufficient to achieve a blood concentration of about 100 micromolar. The patient receives daily injections of antisense oligonucleotide to maintain this concentration for a period of 1 week. At the end of the week a blood sample is drawn and analyzed for the presence or absence using standard techniques well known in the art. There is no detectable evidence of E. coli and the treatment is terminated.

Example 43

Preparation and use of Triple Helix Probes

The sequences of microorganism genes required for proliferation of the present invention are scanned to identify 10-mer to 20-mer homopyrimidine or homopurine stretches that could be used in triple-helix based strategies for inhibiting gene expression. Following identification of candidate homopyrimidine or homopurine stretches, their efficiency in inhibiting gene expression is assessed by introducing varying amounts of oligonucleotides containing the candidate sequences into a population of bacterial cells that normally express the target gene. The oligonucleotides may be prepared on an oligonucleotide synthesizer or they may be purchased commercially from a company specializing in custom oligonucleotide synthesis, such as GENSET, Paris, France.

The oligonucleotides can be introduced into the cells using a variety of methods known to those skilled in the art, including but not limited to calcium phosphate precipitation, DEAE-Dextran, electroporation, liposome-mediated transfection or native uptake.

Treated cells are monitored for a reduction in proliferation using techniques such as monitoring growth levels as compared to untreated cells using optical density measurements. The oligonucleotides that are effective in inhibiting gene expression in cultured cells can then be introduced in vivo using the techniques well known in that art at a dosage level shown to be effective.

In some embodiments, the natural (beta) anomers of the oligonucleotide units can be replaced with alpha anomers to render the oligonucleotide more resistant to nucleases. Further, an intercalating agent such as ethidium bromide, or the like, can be attached to the 3' end of the alpha oligonucleotide to stabilize the triple helix. For information on the generation of oligonucleotides suitable for triple helix formation see Griffin et al. (Science 245:967–971 (1989), which is hereby incorporated by this reference).

Example 44

Identification of Bacterial Strains from Isolated Specimens by PCR

Classical bacteriological methods for the detection of various bacterial species are time consuming and costly. These methods include growing the bacteria isolated from a subject in specialized media, cultivation on selective agar media, followed by a set of confirmation assays that can take from 8 to 10 days or longer to complete. Use of the identified sequences of the present invention provides a method to dramatically reduce the time necessary to detect and identify specific bacterial species present in a sample.

In one exemplary method, bacteria are grown in enriched media and DNA samples are isolated from specimens of, for example, blood, urine, stool, saliva or central nervous system fluid by conventional methods. A panel of PCR primers based on identified sequences unique to various species of microorganisms are then utilized in accordance with Example 12 to amplify DNA of approximately 100–200 bases in length from the specimen. A separate PCR reaction is set up for each pair of PCR primers and after the PCR reaction is complete, the reaction mixtures are assayed for the presence of PCR product. The presence or absence of bacteria from the species to which the PCR primer pairs belong is determined by the presence or absence of a PCR product in the various test PCR reaction tubes.

Although the PCR reaction is used to assay the isolated sample for the presence of various bacterial species, other assays such as the Southern blot hybridization are also contemplated.

All documents cited herein are incorporated herein by reference in their entireties.

SEQUENCE LISTING (469 sequences)

SEQ ID NO: 1 - DNA, 341 bp, Escherichia coli
atttataaataagcattaaccctcattaatgcctgctactgctgattttttccccgcgacatgccgtgtcgcggggatttttttatccgggctttacagcgtttgtgggctcacttgatgacggcggacatccaccggcatcccggaacggacatccatcacatgttgcatcacttcagcgtcagtttgtgctgcatctttaaatgattgcattgcgctattcagcgtaattggcagcagctgcggatcgtcatcaatcttctctgacagcggctgatgtacttcaaccagacgcgcaccgtttggttcggcagagacttttatcggagtgttgatgatat

SEQ ID NO: 2 - DNA, 190 bp, Escherichia coli
aatgcctgctactgctgattttttccccgcgacatgccgggtcgcggggatttttttatccgggctttacagcgtttgtgggctcacttgatgacggcggacatccaccggcatcccggaacggacatccatcacatgttgcatcacttcagcgtcagtttgtgctgcatctttaaatgatagcattgcg

SEQ ID NO: 3 - DNA, 389 bp, Escherichia coli
  misc_feature (1)...(389): n = A,T,C or G
accctcattaatgcctgctactgctgattttttccccgcgacatgccgtgtcgcggggatttttttatccgggctttacagcgtttgtgggctcacttgatgacggcggacatccaccggcatcccggaacggacatccatcacatgttgcatcacttcagcgtcagtttgtgctgcatctttaaatgattgcattgcgctattcagcgtaattggcagcagctgcggatcgtcatcaatcttctctgacagcggctgatgtacttcaaccanacgcgcaccgtttggttcggcagagacttttatcggagtgttgatgatattcactttggtgcctggggtgacctggctaaanagtgttttgatatcgtcatcccgcaaacaaatac

SEQ ID NO: 4 - DNA, 382 bp, Escherichia coli
  misc_feature (1)...(382): n = A,T,C or G
gtgagaaatttttcagctgaagagtaatcatcttgatggggtttgtaatcaacattctgataaatatcattaatatattgtgcagcaatgtgtcggcatactatacggttttggggtcgccccggaaaataacattgaccattaagtttaattcttgggaattctttttcttttctatctgattttaggtttaattcttgtttatcaagagtgtctgagcgttgaggtaaaatttccattaggtatttttcaaatattggggcaatggtttgagtaagtgtcgtgttttcgtttttattaattatcgtaatttctttcttatcagcttgtaagacggacgtggaaaatttaatgacaaaatccttgntgctaaagatatgac

SEQ ID NO: 5 - DNA, 199 bp, Escherichia coli
ataacattgaccattaagtttaattcttgggaattctttttcttttctatctgattttaggtttaattcttgtttatcaagagtgtctgagcgttgaggtaaaatttccattaggtatttttcaaatattggggcaatggtttgagtaagtgtcgtgttttcgtttttattaattatcgtaatttctttcttatcagct

SEQ ID NO: 6 - DNA, 338 bp, Escherichia coli
gtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaacagttcaacgctaatgctctgacctacagtgaactcttcgccttcagccaggcggaattcccacagaccacggccagcttctacgccagctttagcgaagtggccagcttcaggcttggtcacacggttagcttttttagcaccggtggtcacctgaatagcacggtagccatcgttagccaggtc

SEQ ID NO: 7 - DNA, 839 bp, Escherichia coli
  misc_feature (1)...(839): n = A,T,C or G
naccangantgggacccaaatgaaaattgaactgaagattacaatcaatttaacancaagttacacaaccaattcagactccgccagcccaccaatcatgattggacggtgtaaggacaacaccaacaaaaacaggaagttagaagtctnagcaaaacaccgaccagacggtgaggagacataaaaggatacgcaaaggagccgcggctcctggtaacatgaaagcccacagatgtgggctttttcgttgatggtcagaacgaccagttcacaccagctaccgcgttccacggggattccacaccggcactatggctataccccaccccaagatgcccgcttaacgtactgctgaatgaggctttaatacctgcctggtatattccacgtctgcccgacaaataattgacgaaattaccgncactattcactttcacccggttatcatcgacaaattctttgcgcacaagccgncttcagccacggntcaacttccataccgntccccagacgcatgttgtaactcaacgttgcgcccagttcacgatatatactgcgggtatcgactgatttcgatttcatgccattggataaatgatattcggggttatcagcggtgaaacccgttnacgatgcatacngggtcagggttcaattaccatcggtaaatcgcattcccggtttcaatgtgaccgccaancccgttgctgtnggtaactggcattggcgggttcancggtggtaattttaacctggtacgntacttttaaaacgggttaagctttaccgaanaccgtncannattggaaacccncttttaatggttncccaactnggnn

SEQ ID NO: 8 - DNA, 196 bp, Escherichia coli
cctctaccttagaactgaaggccagcttcacgggcagcatctgccagtgcctggacacgaccatgatattggaacccggaacggtcaaaggatacatctttgatgcctttttccagagcgcgttcagcgacagctttacccacagctgcagccgcgtctttgttaccggtgtacttcagttgttcagcgatagctt

SEQ ID NO: 9 - DNA, 472 bp, Escherichia coli
attacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctggccgatcacctgcttatcagcgcctttcagcacgatttcagtctgagtcggacattcagcagtgatacccgcaggcagctgatggtcaacaggatgagagaaacccagagacaggttaatcacattgcctttaaccgctgcacggtaacctacaccaaccagctgcagcttcttagtgaagccttcggtaacaccgataaccattgagttcagcagggcacgcgcggtaccagcct

SEQ ID NO: 10 - DNA, 165 bp, Escherichia coli
cggcatttcacagcattacttggtgatacgagtctgcgcgtctttcagggcttcatcgacagtctgacgaccgctggcggcgttgatcaccgcagtacgcacggcataccagaaagcggacatctgcgggatgttcggcatgatttcacctttctgggcgttttc

SEQ ID NO: 11 - DNA, 328 bp, Escherichia coli
  misc_feature (1)...(328): n = A,T,C or G
cgcgtggagagtcatcagttgcacctgatccagctcttcttcactctcaccacgctcnatcatgtcgcgcaaagtaaagcgcgtcaccacctgggtgagcgtcatcggctcatccagttcactgccttccagcatctccgtcatccagctaaacagttggttgacgttcttcatgcgcatttcggcggctttcgggctgggcgatgtttcgtacagccaggattcataatccatgccatggatcagatcacgcaccgcggcaatcggctcccgctccgccagacgctggatttctgccaaccagtgagtgaagcgggtcaatgcttca

SEQ ID NO: 12 - DNA, 332 bp, Escherichia coli
cacgcaatgagttgaatatgacgcattttatttgtagtttattattttttttatttactattttctgtagcgaaactaatatccagtgtccgccagtatttatggggaataactggacttcattcggccatgatggatcgctcttaatattttcattgagagcgtcttccaggtgagttctggtggagtaggggacgtagagaccagtaggataattgacttgagtattttttgcattagcggcgatcttctgaagatagcaagctatttcatctgtggttaattgacgatttttatcccagaagtttgtaccatcactcagttcattattc

SEQ ID NO: 13 - DNA, 132 bp, Escherichia coli
ccgataattgtcattaatttcgaaggggagaatagttttttgaacaggagatcatctgaatcatgtgatttgaggggggagttggttgcgatatgtgccagattatataattttaaacaagcatttttgata

SEQ ID NO: 14 - DNA, 265 bp, Escherichia coli
cccatgagttcagaattaaaactattaatgacacgcttaagtgaattttctttatcatagcctagtgcacgcaatgagttgaatatgacgcattttatttgtagtttattattttttttatttactattttctgtagcgaaactaatatccagtgtccgccagtatttatggggaataactggacttcattcggccatgatggatcgctcttaatattttcattgagagcgtcttccaggtgagttctggtggagtaggggacgt

SEQ ID NO: 15 - DNA, 665 bp, Escherichia coli
  misc_feature (1)...(665): n = A,T,C or G
ctgtcagcatggttttttaataacgtatagggggcgctgtcagaattgctttccctttgttcaatcacttcctgggctgccatgcacacaaatgcaccgcaactttggcttaagtattgctgaagatcggcatgtaaaaatattatctctggttcatttaaatgaacttttatattattattcgacatttctcccatgagttcagaattaaaactattaatgacacgcttaagtgaattttctttatcatagcctagtgcacgcaatgagttgaatatgacgcattttatttgtagtttattattttttttatttactattttctgtagcgaaactaatatccagtgtccgccagtatttatggggaataactggacttcattcggccatgatggatcgctcttaatattttcattgagagcgtcttccaggtgagttctggtggagtaggggacgtagagaccagtaagataattgacttgagtattttttgcattagcggcgatcttctgaagatagcaagctatttcatctgtggttaattgacgatttttatccccagaagtttgtaccatcactcagtcattattctcatcatttaaaagccctttgaaagcgctggttttcaaatataagaagaggggatccgcgaccctgcagccaan

SEQ ID NO: 16 - DNA, 130 bp, Escherichia coli
agaggaatttcatcaccgataattgtcattaatttcgaaggggagaatagttttttgaacaggagatcatctgaatcatgtgatttgaggggggagttggttgcgatatgtgccagattatataatttta

SEQ ID NO: 17 - DNA, 246 bp, Escherichia coli
  misc_feature (1)...(246): n = A,T,C or G
cttcctgggctgccatgcacacaaatgcaccgcaactttggcttaagtattgctgaagatcggcatgtaaaaatattatctctggttcatttaaatgaacttttatattattattcgacatttctcccatgagttcagaattaaaactattaatgacacgcttaagtgaattttctttatcatagcctagtgcacgcnntnnnttgaatatgacgcattttatttgtagntnattattntttttat

SEQ ID NO: 18 - DNA, 208 bp, Escherichia coli
aatgacacgcttaagtgaattttctttatcatagcctagtgcacgcaatgagttgaatatgacgcattttatttgtagtttattattttttttatttactattttctgtagcgaaactaatatccagtgtccgccagtatttatggggaataactggacttcattcggccatgatggatcgctcttaatattttcattgagagcgtct

SEQ ID NO: 19 - DNA, 159 bp, Escherichia coli
tatgtaagcggcaaacgaatggggtaaacatgccgattttttagtaaatatttcgagagggatatgtttctaatgctaagaaaaaaggtgccgtagcacctttttaatagagaggttttgttaccacacagcagccagcagcgtatgcgagtccggtac

SEQ ID NO: 20 - DNA, 294 bp, Escherichia coli
  misc_feature (1)...(294): n = A,T,C or G
cggtttcaattttcaggaacatccacggggganggtaaacgaatacgtgggnaattttggtggattttcatttgcacttgnctcttcgatcgccttaacaaaatgctgcttgccttgcttgcgccggtgcgcttctacnggattgnccggcgcgatagaaaatcgcttgcctaagcccgncccctgcacaacctggggtntattcacttgcgccaggttttcttgggcgtcacgcccgccaaccggcaaaagactggcgatgtcccgatggcaatacccgcttttaacgctttt

SEQ ID NO: 21 - DNA, 129 bp, Escherichia coli
tcgggttcaattttcaaggaacatccagcggggaggtaaacgatacgtggtaattttggtgattttcattgcactgcctctcgatacgccttaacaaatgctgctgcctgctgcgcggtgcgctctacg

SEQ ID NO: 22 - DNA, 151 bp, Escherichia coli
ctcctgtatctatattctaattaaaaagttaaaaacgttaacggcttatgcgtaccgcaggcacgcgattaccaggcccagatcgcctttggaaaccatggctttcggacgcaggtgacgtttacgtttggtcgcttttttggtcagaatg

SEQ ID NO: 23 - DNA, 579 bp, Escherichia coli
  misc_feature (1)...(579): n = A,T,C or G
ccaggatcttacggtcgatttcaacagaggcttttttcaggccattgatgaatttgctgtaagaaataccgttctgacgtgctgctgcgttgatacgcgcaatccacagttgacggaactgacgcttacgttgacgacggtcacggtaagcatactgaccagctttgataacagcctggaaggcaacgcggtatacgcgagaacgcgcaccgtagtagcctttagcttgtttcaaaattttcttgtgacgtgcacgtgcaataacaccacgttttacgcgagccatatgtgctctcctgtatctatattctaattaaaaagttaaaaacgttaacggcttatgcgtacggcaggcacgcgattaccaggcccagatcgcctttggaaaccatggctttcggacgcaggtgacgtttacgtttggtcgcttttttggtcagaatgtgacgcaggttagcgtgcttgtgcttaaaaccacctttaccggtttttttgaagcgcttagcagcaccgcgtacggtcttaatttttggcattttaataacttncacttcgcattggtaataaacgaaacaaagg

SEQ ID NO: 24 - DNA, 222 bp, Escherichia coli
  misc_feature (1)...(222): n = A,T,C or G
gagggtgcaacaggggtgagtagaatggttctttattttcatggtgtanggccttctgtngttngaggacagttttaataaagttacaatcaccgcgataaacgtaaccaatttttagcaactaaacaggggaaaacaattacagatttttatctttcgattacgatttttggtttatttcttgatttatgaccgagatcttacttttgttgcgcaattgta

SEQ ID NO: 25 - DNA, 278 bp, Escherichia coli
ggagagtttgcagtcatttaaaaggtaacatgacaatgcatgatgaatataacaacatatgatgttatgtaatgtgggaggaaagatcacaaaatttcgcacaggatcgcgctgtggctaatggatgtagttatcaaattgaatttaaagtgaaaatatttttacgggcgggggcaagaaggacatataaacaaatacgccctcggaaaatccagagggcgtcgggcaattaaaccggtgttagccgatttctgtcagagacttactgtgcagtagga

SEQ ID NO: 26 - DNA, 156 bp, Escherichia coli
  misc_feature (1)...(156): n = A,T,C or G
tgaaatncgaccgaaggtagtttcggaaacagtcagcgcgctctgcgcgtctttcaatactaattccattgctatctccttacgccttcacagctggtttaacgatcaggtcgctaccggttgcacccgggacagcacctttaaccagcagcaggt

SEQ ID NO: 27 - DNA, 143 bp, Escherichia coli
  misc_feature (1)...(143): n = A,T,C or G
gcgcgtctttcaatactaattccattgctatctccttacgccttcacagctggtttaacgatcaggtcgctccggntgccccgggacagcacctttaaccagcagcaggttgcgctcagcgtcaacgcgtactacgtcaaggc

SEQ ID NO: 28 - DNA, 266 bp, Escherichia coli
gcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcacctttaaccagcagcaggttgcgctcagcgtcaacgcgtactacgtcaaggctctgaacggttacacgttcgttacccatctgacctgccattttcttgcctttgaacactttgcccggag

SEQ ID NO: 29 - DNA, 535 bp, Escherichia coli
gcataagcaacaacaacctggtgaaccagcgcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcacctttaaccagcagcaggttgcgctcagcgtcaacgcgtactacgtcaaggctctgaacggttacacgttcgttacccatctgacctgccattttcttgcctttgaacactttgcccggagtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaacagttcaacgctaatgctctgacctacagtgaactcttcgccttcagccaggcggaattcccacagaccacggccagcttctacgcca

SEQ ID NO: 30 - DNA, 223 bp, Escherichia coli
ttcaacgctaatgctctgacctacagtgaactcttcgccttcagccaggcggaattcccacagaccacggccagcttctacgccagctttagcgaagtggccagcttcaggcttggtcacacggttagcttttttagcaccggtggtcacctgaatagcacggtagccatcgttagccaggtctttaacctgagtaacgcggtttgcttcaacttcgattacg

SEQ ID NO: 31 - DNA, 225 bp, Escherichia coli
  misc_feature (1)...(225): n = A,T,C or G
cgctctgcgcgtctttcaatactaattccattgctatctccttacgccttcacagctggtttaacgatcaggtcgctaccggntgcacccgggacagcacctttaaccaacagcangntgcgctcaacgtcaacgcgtactacgtcaaggctctgaacgggtacacgttcgttacccatntgacctgncattttcttgcctttgaacactttgcccggagtctgg

SEQ ID NO: 32 - DNA, 341 bp, Escherichia coli
tgctatctccttacgccttcacagctggtttaacgatcaggtcgctaccggttgcacccgggacagcacctttaaccagcagcaggttgcgctcagcgtcaacgcgtactacgtcaaggctctgaacggttacacgttcgttacccatctgacctgccattttcttgcctttgaacactttgcccggagtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaac

SEQ ID NO: 33 - DNA, 176 bp, Escherichia coli
aacaacaacctggtgaaccagcgcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcacctttaacc

SEQ ID NO: 34 - DNA, 241 bp, Escherichia coli
tcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcacctttaaccagcagcaggttgcgctcagcgtcaacgcgtactacgtcaaggctctgaacggttacacgttcgttacccatctgacctgccattttcttg

SEQ ID NO: 35 - DNA, 224 bp, Escherichia coli
  misc_feature (1)...(224): n = A,T,C or G
tgntctaatctgattacgaaaaagatatgttgcgggaggcgttgcctccccaacatataagtggctccctcaagccacttcctttagaagcacaaccttgcttctaactatataaaccttctgttatatattaccctttatttttgggggcgtctcaacgccccatttttaataatttttagtaaacaattggcatattaattagagttattaacaacgatatc

SEQ ID NO: 36 - DNA, 413 bp, Escherichia coli
aacatcctcttgtgtgaataaaacaaccggaccccatcgaggaacggagtccggtgtcatattaaaagcccgaaaattttactcatttttgcgggaattgcaatcaacagttgctaactctgctgtaaaaggccgtcggcggtgcagccagtttggtgccggagtgcgcgcagtcaccggagcgtacacgcagtacgtgaggatgacgagcacatcccggtgccaaaatggcaaacaagccaggccgattagcgaccagggaagcctgggggcatcatacccttcatgcttctcatcatcttcgccattccgcccttcttcattttcttcatcatgcgctgcatgtcgtcgaactgtttcagaagacggttaacgtcctgcacctgcataccgcaaccggcagcaatacggcg

SEQ ID NO: 37 - DNA, 509 bp, Escherichia coli
cagcgacaacaacctggtagaacggacgctttttagcgccgtgacgtgctaaacgaatagttaccataacatcctcttgtgtgaataaaacaaccggaccccatcgaggaacggagtccggtgtcatattaaaagcccgaaaattttactcatttttgcgggaattgcaatcaacagttgctaactctgctgtaaaaggccgtcggcggtgcagccagtttggtgccggagtgcgcgcagtcaccggagcgtacacgcagtacgtgaggatgacgagcacatcccggtgccaaaatggcaaacaagccaggccgattagcgaccagggaagcctgggggcatcatacccttcatgcttctcatcatcttcgccattccgcccttcttcattttcttcatcatgcgctgcatgtcgtcgaactgtttcagaagacggttaacgtcctgcacctgcataccgcaaccggcagcaatacggcgtttacgcgaacctttgatgatttctggct

SEQ ID NO: 38 - DNA, 149 bp, Escherichia coli
gatttttaccggattaattttaaacatggtctgatttcttttattgagctagtcaaaatgcggtgataagagcgggattgtcccaatccacgctcttttttatagagaagatgacgctaaattggccagatattgtcgatgataatttg

SEQ ID NO: 39 - DNA, 118 bp, Escherichia coli
gtttcatccctggcaagcagaacggctttttcgttatttatatcgggagaattaatatgaaactgcaataaattctttaatgtgatacaagcctgggcgttcttttttccttcaattg

SEQ ID NO: 40 - DNA, 147 bp, Escherichia coli
gcagaacggctttttcgttatttatatcgggagaattaatatgaaactgcaataaattctttaatgtgatacaagcctgggcgttcttttttccttcaattgcgacaaatgtaatactttggttaatgattggttggtcgtttacat

SEQ ID NO: 41 - DNA, 224 bp, Escherichia coli
caattgccgagcgtttcatccctggcaagcagaacggctttttcgttatttatatcgggagaattaatatgaaactgcaataaattctttaatgtgatacaagcctgggcgttcttttttccttcaattgcgacaaatgtaatactttggttaatgattggttggtcgtttacataaacactgacgtcgtaaacacccggtatagcggggttaccttcactgta

SEQ ID NO: 42 - DNA, 506 bp, Escherichia coli
tgaggcaattgccgagcgtttcatccctggcaagcagaacggctttttcgttatttatatcgggagaattaatatgaaactgcaataaattctttaatgtgatacaagcctgggcgttcttttttccttcaattgcgacaaatgtaatactttggttaatgattggttggtcgtttacataaacactgacgtcgtaaacacccggtatagcggggttaccttcactgtaccggctgagatcaatattagatgcattctgccccatcaggaaggtatggtcatattcaacgagttcagcactgaaagcagtattgcaatacagcagcgcgcaaaacgtggcgatacgggtcagatgatgataatttttagtatattctatagtcacgctatgcttcctgcggaattatatccttgcctgattacagcctggcattaccttcaattgcgccaccaaagtcattaatggcgtaaaaatgcacttttgcagaattcgctttgccattaag

SEQ ID NO: 43 - DNA, 184 bp, Escherichia coli
caggcttgaggaacgtctatatccagacgttgatcgttaacgtcataacgaacagaagcctgagggataatttccgtcaaattgaggcaattgccgagcgtttcatccctggcaagcagaacggctttttcgttatttatatcgggagaattaatatgaaactgcaataaattctttaatgtga

SEQ ID NO: 44 - DNA, 327 bp, Escherichia coli
  misc_feature (1)...(327): n = A,T,C or G
ggctggaggtgatgaccgncatttccctgatgccagcagcctgttcggcagataactgcaatgtacgatcaggttctgtggtttcggtggtagaaaagcgcaaaacatcgctgctttncgtcaaccgccagtatggattgtgcgatccgagaaagttgtacaacgttgtggactccctaacggttttcatgatgcatatcctccggttaacagcggagtccgcggttaaataaaaggaacaacatgacttacatgaaattaacggcggctaaacgcattgntttttttatatatttatttgtaatccagttttggaaaaacgccagt

SEQ ID NO: 45 - DNA, 215 bp, Escherichia coli
cgctgggcatcaaattcagacatcaaggacatccttatagcaaaagggggaaaatgaataatgcaaaaattgccgctaaaagagaagtgtttaacagcaacggctaattatcatccaggaatacgatatataatgacgggatatagcgctaagtatatatattcatctacttatgcgcgcttcagatagcgtttataccagcgttcgaaggcgac

SEQ ID NO: 46 - DNA, 121 bp, Escherichia coli
aaataactttccgcatagcttaaaaaggagggtaaaatggcaagagatgaataacaaattccggccagacaccaggtatacctctgcggaatatccgtagtagtgggtattttcataatta

SEQ ID NO: 47 - DNA, 160 bp, Escherichia coli
tgcaaggcaggcgctgaaagaggcgaatagtctacctggattatggtgaattgctccgccagatgttacagggtttattcactcatcgcatcgcgccagatcttgtcaacgatacgttgcgccagcacggcctgttcgccggcggtttgcggaactgggg

SEQ ID NO: 48 - DNA, 195 bp, Escherichia coli
tgcgggggaatttaaactgtgaaaagattcacaaatagctgcggttaggaatgtgatatccgcagcttatcaggtgaagtaataattattctcaataattaactggagaggggaatattaacgatagaaaataagataaacaatcatgccgatagataaaattccgaagccgatatatgccaccatataagcgaa

SEQ ID NO: 49 - DNA, 167 bp, Escherichia coli
gtgaaaagattcacaaatagctgcggttaggaatgtgatatccgcagcttatcaggtgaagtaataattattctcaataattaactggagaggggaatattaacgatagaaaataagataaacaatcatgccgatagataaaattccgaagccgatatatgccacca

SEQ ID NO: 50 - DNA, 226 bp, Escherichia coli
ataatgtactgatattaaggctaagcgtgcgggggaatttaaactgtgaaaagattcacaaatagctgcggttaggaatgtgatatccgcagcttatcaggtgaagtaataattattctcaataattaactggagaggggaatattaacgatagaaaataagataaacaatcatgccgatagataaaattccgaagccgatatatgccaccatataagcgaaaaag

SEQ ID NO: 51 - DNA, 185 bp, Escherichia coli
ccgaatgacctgtgcggatagttaattggcatgccgacgctggagtaggcatccatcatctgttctgaggttatcacttcaatctggtgcgggtaggtatccagccggtagagtttcgccacccggtctatctctgccagataaacatccagcaggtcgaacgtccagtcgggtccatcgctcaa

SEQ ID NO: 52 - DNA, 187 bp, Escherichia coli
ttctgattaacagcggacttaatcttgagcaaagtcaatgggcgacaatgcaaattataatgctattaattttatactgttcaagcatgttatgtctggctgaagccaatttagccacagtaaccgttaatgatggcgaaacttcatcaatattaattcgtaaagcatctatctctgtatcattaat

SEQ ID NO: 53 - DNA, 337 bp, Escherichia coli
aagagggtttagttctctcggtaatgcgctaacctcaacaggctctcggctatcgttataattcagcgcttccgttacaccactcaactttttgatctctcgtaatcccgttctgattaacagcggacttaatactgagcaaagtacaatggcgacaatgcaaattataatgctattaattttatactgttcaagcatgttatgtctggctgaagccaatttagccacagtaaccgttaatgatggcgaaacttcatcaatattaattcgtaaagcatctatctctgtatcattaataatgcttctgtaaatgccagctgcgctgattgtctcacta

SEQ ID NO: 54 - DNA, 192 bp, Escherichia coli
ctgagcaaagtacaatgggcgacaatgcaaattataatgctattaattttatactgttcaagcatgttatgtctggctgaagccaatttagccacagtaaccgttaatgatggcgaaacttcatcaatattaattcgtaaagcatctatctctgtatcattaataatgcttctgtaaatgccagctgcgctg

SEQ ID NO: 55 - DNA, 239 bp, Escherichia coli
gattaacagcggacttaatactgagcaaagtacaatggcgacaatgcaaattataatgctattaattttatactgttcaagcatgttatgtctggctgaagccaatttagccacagtaaccgttaatgatggcgaaacttcatcaatattaattcgtaaagcatctatctctgtatcattaataatgcttctgtaaatgccagctgcgctgattgtctcactagcaggtatgttattta

SEQ ID NO: 56 - DNA, 240 bp, Escherichia coli
gattaacagcgggacttaatactgagcaaagtacaatggcgacaatgcaaattataatgctattaattttatactgttcaagcatgttatgtctggctgaagccaatttagccacagtaaccgttaatgatggcgaaacttcatcaatattaattcgtaaagcatctatctctgtatcattaataatgcttctgtaaatgccagctgcgctgattgtctcactagcaggtatgttattta

SEQ ID NO: 57 - DNA, 330 bp, Escherichia coli
cacaacccagtgatgtggctggtgcgcttcaggatgcgatctgcacgaccttttgcacgcggcataatgcgcttcatgctcgggccttcgtctacgaaaattttcgtaactttcagatcgtcaatgtcagcgccatcgttgtgttcagcgttagcaatggcagattccagaactttcttgaccagtacagccgctttcttgttggtgtaggtcaaaatatccagagcctgcgacactttcttaccgcgaatcaggtcagcaacaaggcgaaccttctgagcagaagaacgagcatggcgatgtttagcgatagtttccatctcttcctcc

SEQ ID NO: 58 - DNA, 266 bp, Escherichia coli
gctttcttgttggtgtaggtcaaaatatccagagcctgcgacactttcttaccgcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccaaccatttcgtcggttacaaataccggaacgtgctgacgaccatta

SEQ ID NO: 59 - DNA, 186 bp, Escherichia coli
gcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccaaccatttcgtcggttaca

SEQ ID NO: 60 - DNA, 138 bp, Escherichia coli
gaagaacgagcatggcgatgtttagcgatagtttccatctcttcctcctaccttatttcttcttcgcttttttatcagcagcgtggccgcgataagtacgagtcggtgcgaattcacccagtttgtgaccaaccattt

SEQ ID NO: 61 - DNA, 183 bp, Escherichia coli
tgtgttcagcgttagcaatggcagattccagaactttcttgaccagtacagccgctttcttgttggtgtaggtcaaaatatccagagcctgcgacactttcttaccgcgaatcaggtcagcaacaaggcgaaccttctgagcagaagaacgagcatggcgatgtttagcgatagtttccatct

SEQ ID NO: 62 - DNA, 135 bp, Escherichia coli
ggtcaaaatatccagagcctgcgacactttcttaccgcgaatcaggtcagcaacaaggcgaaccttctgagcagaagaacgagcatggcgatgtttagcgatagtttccatctcttcctcctaccttatttcttc

SEQ ID NO: 63 - DNA, 141 bp, Escherichia coli
tgctaaacgaatagttaccataacatcctcttgtgtgaataaaacaaccggaccccatcgaggaacggagtccggtgtcatattaaaagcccgaaaattttactcatttttgcgggaattgcaatcaacagttgctaactc

SEQ ID NO: 64 - DNA, 144 bp, Escherichia coli
tgctttgctcgcctcatgacgattatgatcgttttgttttaaaggaggaagtatcggcagtagacgaatgagtacgatgtaagcgcaaatctcaatagccacaaaaccaatagaaatcaacagttcttcccaggtcgggaagta

SEQ ID NO: 65 - DNA, 70 bp, Escherichia coli
cggcttagcgcgtcgttggcatcgagcatcgctcccatgccgtttgccagttgatagcgtccatcttgcc

SEQ ID NO: 66 - DNA, 175 bp, Escherichia coli
accatacagagaggagatcaaagatgtgccacttgaccggaacagcgtttacagcatgttggataaaagtatcaagtttactcattcgcttcagtctgttgttattgttgtgatttatgaatcatagcacaggtcgtatcgacttctggccctggcgctttaccccaccagggcc

SEQ ID NO: 67 - DNA, 867 bp, Escherichia coli
  misc_feature (1)...(867): n = A,T,C or G
ccagatttgcccccgcaaanccgacccattgaacgccgacctgaccgtgaatcaagcgttcatcaatccggcttaaaacaatattnggcatagcgtgttcctctttgttttgcttattggccttcacaggctgtgtggtactgcgccaggatgtcctgaatatggttgataatgagttcccgtggcgttggctgcagctcgccggagcgaactttcacgtactgcagcggcagatactggctgatcagcggcagcggaattggtgaatccgccagattacgtaccagatgagcgaaagcgtcatcaatctggctgtccggccagtaatagcgcacgcgatccgagtagctataaccacgcgccagacgacgcgcgttgccggtcaccgtggtagtggctttgccagtattcccgggcggtcgagcatcacgtcttccaagcaccctgacgcagaccagaacangctttcgctggcaccagttctttttnaatcgccgccagagagaacagagcttacgcagggcagaaaggtcancnctgggccaactttcagaatggcaaagtgggcaaatcaccaagcttgncgcagcgattgctgcgttttgataatcgggtagaagtgcncttcggaaaatcagcgtttncgtaagttttccgacccatcntggnttaaaggcgctcngtttggcggggcntgatnaatcaaattaacntttggngtgatcngaattccaacnccngggttgnanccancaggggnaatgatgccntgggcnanatngnnatttaaaccttggntttttaaaaggcntggcctangggctttcaacntnggtncccgggccngnatncngcntgntgacccct

SEQ ID NO: 68 - DNA, 703 bp, Escherichia coli
  misc_feature (1)...(703): n = A,T,C or G
ccgccggggcgggtttttttacgttgcttcagattactctgcagcagcttctgctttctctgaacgatcaaccagctcgatgtaagccatcggcgcgttgtcgcctgcacggaagccacacttcngaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacagtccacgggaagccagcacgtctttaatctcagtaagagattttttaccaaggttaggcgttttaaggagctcaacctcggtacgctgtaccagatcaccgatatagtggatagcttctgctttaaggcagttagcagagcggacagtcaattccagatcgncaacagggcgcaacaggatccggatcga

SEQ ID NO: 69 - DNA, 328 bp, Escherichia coli
cgttgtcgcctgcacggaagccacacttcagaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgacctt

SEQ ID NO: 70 - DNA, 414 bp, Escherichia coli
cgggtataaaaaaacccgccggggcgggtttttttacgttgcttcagattactctgcagcagcttctgctttctctgaacgatcaaccagctcgatgtaagccatcggcgcgttgtcgcctgcacggaagccacacttcagaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgacc

SEQ ID NO: 71 - DNA, 327 bp, Escherichia coli
cgcgaaacgcgggcccagttcgttaaaacagttttgccacgatctcgttatcacgagtacgggcgaatgccagacgacgattagcaacgctatcagtcttggcaagagtaatcaagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgaccttatccttctcaagtaaaaccttaacctgtgatccggttactcgtcagcgatgcttg

SEQ ID NO: 72 - DNA, 209 bp, Escherichia coli
  misc_feature (1)...(209): n = A,T,C or G
caactctgtctntttaagcagagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttcc

SEQ ID NO: 73 - DNA, 311 bp, Escherichia coli
aacataaggagtgcattatgcgcatagctaaaattggggtcatcgccctgttcctgtttatggcgttaggcggaattggtggcgtcatgctcgcaggttatacctttattttgcgtgctggctaagcgcctgcaccagcctttcaaacaggcggtctgcgatgatcgccgcagtgccaccagtaacgccccctggatcacatacgcggtattaaatccgctaagcccgatgatgatgggcgtacccagcgtgctggcccctaccgttgaggcgatcgtcgccgtaccaatgttgataatcaccgaagttcg

SEQ ID NO: 74 - DNA, 167 bp, Escherichia coli
cgcgaactcgatctggataccgataatgttagcccgctttcagcgtgttcaggtctactacacccgccttctactttagccaggtcagacagacgaatttcggctgtaatcgctgctttacgagaagtgaagccgaatttcggcagacgacggtacagaggcatctg

SEQ ID NO: 75 - DNA, 151 bp, Escherichia coli
gcagaaaaacacgttttttaggtttatcagcatattgcgctttcaattgcgcgtactgatccagcagggattgcgcggcttgttcggccttgtctggttgcggactccagggggccagttgacgtaacgcattggcaatttgttcaatgct

SEQ ID NO: 76 - DNA, 151 bp, Escherichia coli
gcgtcaaagtcgctgctgtcgataaagcgcacgtcgttggtcgccacgacgggcaaaccgcgcgcttccgccagttccaccgccgcgtgcagatagctttcttcatccggcctgccggtgcggatcagctcgagaaaatagcgatccggga

SEQ ID NO: 77 - DNA, 115 bp, Escherichia coli
taaccgctattgatcgcaggctgaccgcagcatccctgtttctccgggaaatttacgcgacagccgagtttttccagtagcagcacggagtctcgtgccattcttgatttcaggg

SEQ ID NO: 78 - DNA, 220 bp, Escherichia coli
taaaaatggttgacataaacttgccataagccgtgggaggcacagaaaaatcaatgatacggaatgtgttctcactatgaccactgaaatcaatattcggcgtcccggtttctagcaattcgataaattgcatatgtttactgccgatagattttaaaaaatgataaacctcaagagggtaatggacattaacgttattaatgacggttaacgtattaaa

SEQ ID NO: 79 - DNA, 258 bp, Escherichia coli
ctaaaggattgagttatcgcattatgcccatgaagccatgtacgcccatatacacaccgactaagccaatcaacagactggaaaaatagggggcgcgtttagcgagagtgttaaatccgctccagcgttttgcgacctgctgaacgctgattgctgcgccaacgcctacggtgacaagcgttaacgccaggccaatgctgaaactgacgaccagtgttgcgcccagtgtcagggctttcaactgaatgcatatcaaca

SEQ ID NO: 80 - DNA, 311 bp, Escherichia coli
catatattttatcaagcttctggtatgtttttttatagaacgcaaaatcagtcttgagtagtacggaagggctattgttgtaattaataatatcatctggttttaggacaagtaaaaaacccgttaagtaatttgcattaatgttatacgtatttgttaaatccgatatttgctggtattcacacttcatcttcttatttttatcaagcctagatagaggtgcaacatgattttcaattttatattttttatcatttattattatatcgtatgtataatcatgtaaaataccattcgttgttattggcata

SEQ ID NO: 81 - DNA, 281 bp, Escherichia coli
caaaatcagtcttgagtagtacggaagggctattgttgtaattaataatatcatctggttttaggacaagtaaaaaacccgttaagtaatttgcattaatgttatacgtatttgttaaatccgatatttgctggtattcacacttcatcttcttatttttatcaagcctagatagaggtgcaacatgattttcaattttatattttttatcatttattattatatcgtatgtataatcatgtaaaataccattcgttgttattggcataaatgcgaaagca

SEQ ID NO: 82 - DNA, 402 bp, Escherichia coli
aacaataaatatataacagcggttatgagtatggctattattattgcggaaactaatggaatcattgccgataaaatcattggaatatgttttatcttattaaggtggaaaaggagggaatttgataaacacataaacagtgacaataaaatcgccccaaaaagattatatagtatatttaacaaaatattattcatggctatattgtctaaggcgtgtattaacgccacatctgttattgttagtacaatccatgtaatagctaataatgttaaataagctttaattctatgctgtataaaaacagatgcaataaatactgcaacagcagatatgaggtaccatgcggtttccagtgaaaaataaaattgttttatgtaatcaagtttcattgagcattca

SEQ ID NO: 83 - DNA, 273 bp, Escherichia coli
aatgttatacgtatttgttaaatccgatatttgctggtattcacacttcatcttcttatttttatcaagcctagatagaggtgcaacatgattttcaattttatattttttatcatttattattatatcgtatgtataatcatgtaaaataccattcgttgttattggcataaatgcgaaagcaaccatcaattgtgcattgtttgatttaaattttatttgagagtcagtaacacttgaggctagcataaatttatcatcttgcttgctcaa

SEQ ID NO: 84 - DNA, 162 bp, Escherichia coli
  misc_feature (1)...(162): n = A,T,C or G
gnnnnnnnnnnntttnttnttttggggccgcgtacatangccagggatctaggagtaagaatagcttcgaattccctccctggaggcaccacctaaattttcctgaagttgagcgaggttaatgttggcataacgataaaaaacacccgatgaaaattcctg

SEQ ID NO: 85 - DNA, 131 bp, Escherichia coli
ccaataataataatgtcgcagtcgtcttccatgtcatgccccagatatccagaacacaacaccctaacatagcgttacttaagggaaattgaccgccgacacactcttatcattcgccgcgatagatacaa

SEQ ID NO: 86 - DNA, 207 bp, Escherichia coli
gaattttcagacggctaacaatgagacaccagattaaatgatagtcggggagggagagaagaggagggcgcaatggctgcgcccgaaaaataaattagtcgcgcttcgcgccagtacgcagcaggccggatgcgccttcagaatagtcgcgaggcatctgcaccggtgcctgatcgttgctggcttcagactctgccagacgattac

SEQ ID NO: 87 - DNA, 247 bp, Escherichia coli
taacgctaatgcactcaacagctgggtttgttttttcattattcctgctctcgtacctgaatgataagaaaagagattcaaaacagtttgatgttattgaattttcagacggctaacaatgagacaccagattaaatgatagtcggggagggagagaagaggagggcgcaatggctgcgcccgaaaaataaattagtcgcgcttcgcgccagtacgcagcaggccggatgcgccttcagaatagtcg

SEQ ID NO: 88 - DNA, 238 bp, Escherichia coli
tgaatgataagaaaagagattcaaaacagtttgatgttattgaattttcagacggctaacaatgagacaccagattaaatgatagtcggggagggagagaagaggagggcgcaatggctgcgcccgaaaaataaattagtcgcgcttcgcgccagtacgcagcaggccggatgcgccttcagaatagtcgcgaggcatctgcaccggtgcctgatcgttgctggcttcagactctgcc

SEQ ID NO: 89 - DNA, 582 bp, Escherichia coli
  misc_feature (1)...(582): n = A,T,C or G
ttcaaaacagtttgatgttattgaattttcagacggctaacaatgagacaccagattaaatgatagtcggggagggagagaagaggagggcgcaatggctgcgcccgaaaaataaattagtcgcgcttcgcgccagtacgcagcaggccggatgcgccttcagaatagtcgcgaggcatctgcaccggtgcctgatcgttgctggcttcagactctgccagacgattacggaacgggtttgcttcagcagacagttccggcagcaggctgctggagctttttgccttctatcaaagcctgccgggagagcggaaacagcgcctgcactttcaccgttttatgctgcgggtgcatgaagagctaactgccttacaggggcagaccgatccgctggaaattattgccgatcgctttaaagcccgaaactgacgtgctctgttttgacgaattttttgtttctgatattacccgatgccatgctacttggcggtctgatgaaagccctgttcgctcgcggtattaccctggtagcgacgtcaaatattncgccggatgaactttatcgaaatggcctgcaacgtg

SEQ ID NO: 90 - DNA, 287 bp, Escherichia coli
  misc_feature (1)...(287): n = A,T,C or G
tgcactcaacagctgggtttgntttttcattattcctgctctcgtacctgaatgataagaaaagagattcaaaacagtttgatgttattgaattttcagacggctaacaatgagacaccagattaaatgatagtcggggagggagagaagaggagggcgcaatggctgcgcccgaaaaataaattaagtcgcgcttcgcgccagtacgcagcaggccggatgcgccttcagaatagtcgcgaggcatctgcaccggtgcctgatcgttgctggcttcagactctgcc

SEQ ID NO: 91 - DNA, 200 bp, Escherichia coli
taccagatcaccgatatagtggatagcttctgctttaaggcagttagcagagcggacagtcaattccagatcgtcaacagggcgcagcaggatcggatcgaactctggtttctcttctttcacttcaggctgacgtacatcacgtaagtcaacgaaagcttccagttgttcagccagaatggttgccgcacgacgaatcg

SEQ ID NO: 92 - DNA, 278 bp, Escherichia coli
ccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtc

SEQ ID NO: 93 - DNA, 424 bp, Escherichia coli
cttagccatttagtaaccctaccttacttgcggaacgggaagtcaaaggcagccagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttt

SEQ ID NO: 94 - DNA, 161 bp, Escherichia coli
gactgggagttaacaagcgtaactccctgggaaatgcgagcttaaccactcaggggttagctttattacttagaaacggtcagacgagcgcggcctttagcacgacgacgtgccagaacctgacgaccatttttagtagccatacgagcacggaagccgtg

SEQ ID NO: 95 - DNA, 187 bp, Escherichia coli
tggctgctggaagacgaatgtgaattgactgggagttaacaagcgtaactccctgggaaatgcgagcttaaccactcaggggttagctttattacttagaaacggtcagacgagcgcggcctttagcacgacgacgtgccagaacctgacgaccatttttagtagccatacgagcacggaagccgtg

SEQ ID NO: 96 - DNA, 236 bp, Escherichia coli
tgccagcccgttgtggctgctggaagacgaatgtgaattgactgggagttaacaagcgtaactccctgggaaatgcgagcttaaccactcaggggttagctttattacttagaaacggtcagacgagcgcggcctttagcacgacgacgtgccagaacctgacgaccatttttagtagccatacgagcacggaagccgtgagaacggttgcgcttcagtacagacggttgaaaagt

SEQ ID NO: 97 - DNA, 828 bp, Escherichia coli
  misc_feature (1)...(828): n = A,T,C or G
gcgaattcaggcggccgagaatggtaatttgcggcgtgccagcccgttgtggctgctggaagacgaatgtgaattgactgggagttaacaagcgtaactccctgggaaatgccagcttaaccactcaggggttagctttattacttattaaacggtcagacgagcgcgggctttatcacgaccacgtgccngaacctgacgaccatttttagnagccatactagcacggaagccgtgagaacggnngcgcttcagtacanacggntgaaaagngcctttcatggcnatttctggggatnncgtcnacctgcngnnctaacataangggnnggggccnctaaacgggtccttgaggggttttttgaagcttgggcttttcancctgatncagattaaatcanaacgccngaancggtctgataaaacanncnnnncntngncttntcnnnatttgcnacnnntccnccacnnnngtgcatnccnntnncanagnactncgantnnccnncntnnngcntttnngnngcnntatnnangctgtctcgncccnnnnccncttnnnnnnttnnccgcnnnatccntnnactnnacccnnntncacgnnannctncnnccgcncnnnnnctcnatntnttnnngntctcnnntgncnnnnnnntntctnatgncgtnncncnnncnnnctcctnnnncatgnctttctncnactnnntatcnncngtcnnttncnncnnnnaannncntctcntcnnnnnngnntnccatcgntcanncgnncgnncnntnacntcctantnnnnnnnnntcnnnntatcnnnatctggcccg

SEQ ID NO: 98 - DNA, 183 bp, Escherichia coli
gctgctcgtcggtcgcgtcgaggttaacgaacagatcgaatacctgatccacaacccaatcaggacgcgcgccagggcggtcaactttgttgataacaacaatcggcttcaggccgtaagcaaacgcttttttggttacgaagcgcgtttgcggcatcgggccgtcaaatgcgtcaaccacca

SEQ ID NO: 99 - DNA, 192 bp, Escherichia coli
ggcatcatgctgtgttgcgcggcaacgcgaaagacgtctggcgtcaggcatggcagggtgagtatgggcgtagcgctacgttgccatactggtatttgcgagagatctttattcagaaaccggaggtaatctttgatgatgtcgtgactaatatgagcaaccaaagtgttgttaagagaggagacgtcgata

SEQ ID NO: 100 - DNA, 242 bp, Escherichia coli
taattttgttggaaagtaatcatatataaattttggaaccaaccctgcaatacctaaatttgtaaacattaatccaaagagacataatcctataagagaagagtttttcacagaaataaaaaaaagaggacaaaggaaaataaatgaagttattagaccgactacaaaggctttttttacaccaatcttatcaccaacaaaaccaaaaaatattgtacctgtcagtgttcctaaacctgcta

SEQ ID NO: 101 - DNA, 177 bp, Escherichia coli
gacgcggcgaacgatttcggcttgttcttttactggaggtaataaaacaacttgggatttgatatcttttcctgaaatacctttttgaccagaagttgttttcacgcagttcatcattgcatttcgtgctgagggggatgaaaaaaatatttcgatatattctggtaaagcatcttt

SEQ ID NO: 102 - DNA, 250 bp, Escherichia coli
gacctgtttttctatggtgtcggcgtaggcgaagagttgctcgacgcggcgaacgatttcggcttgttcttttactggaggtaataaaacaacttgggatttgatatcttttcctgaaatacctttttgaccagaagttgttttcacgcagttcatcattgcatttcgtgctgagggggatgaaaaaaatatttcgatatattctggtaaagcatctttggttaatcgagctcgaataagtttatcagga

SEQ ID NO: 103 - DNA, 194 bp, Escherichia coli
ttaggtcgaacacctttcggcgcgaacaagccctggtattcattggcgatgctgtgtcgaatcacctgctcaggtgaaaaaccctgctggcggaatttttccagctcccgtatcgccccgttagcgccctgctccgttcgaatcggttttcgcaatgcctggcgaaattcaacccactcacgccaaagcgagac

SEQ ID NO: 104 - DNA, 173 bp, Escherichia coli
tccataaatccctcttaatttcacgtatcgaataacgttgttttaatctagctatgaggaacaaataaaataaaaatattatttttaatactgaagcaacatctttggctgctttcttttttaatattgctggccgattcattttctgatatcggccatttttattgcgggta

SEQ ID NO: 105 - DNA, 173 bp, Escherichia coli; identical to SEQ ID NO: 104

SEQ ID NO: 106 - DNA, 142 bp, Escherichia coli
aacagctccagcgccaacagcgctccaacgcccgccgagggcagggtggagagaatcgtcagcggatgtacgtaactctcgtaaaggatacccagcacgatatacaccgtggcgatggcggcgataatcaggatcacctgcg

SEQ ID NO: 107 - DNA, 263 bp, Escherichia coli
aaaatcttattcagcgccttcatttggtttgggcctttaatcccttagagccatcccgttgagcaagggtggcgtaacccgatcatcacaataatatcgaccacaatagtggtgacgcccgagcacgatatactgcatcagttgcggctgttgcggcatgatgaattgcggaaatagcgccgccagaaacacaatacttttgggattggtgagattcacaaaaactgcgcgctggaacaaatgtcgacgcgattgagtagggg

SEQ ID NO: 108 - DNA, 235 bp, Escherichia coli
tcggaagcctgaatgcggatacgtagcgcagcttgcagcggttcgtccagcttattgacccacaaatgctgatcgcccagcgccagcgcggtcatcgcgtaatgcggatgatgctcaagcaccgtcactttcagaatgctactttgttgctctttcggcagccacggattcatcacgctactgccccacacttcctccagcgcgccaaaggctttcacctgaccgttttccagta

SEQ ID NO: 109 - DNA, 147 bp, Escherichia coli
gccaggatgacactttttgtgtaatggccggagttcacatttttaatttagatcaaaggggggaagaataagcagaaaaagcccgccataacagcgggcaggagggatttagaactgataaaccagacctaaagcgacaatatcatc

SEQ ID NO: 110 - DNA, 241 bp, Escherichia coli
tcataaaacctcctgttttagtatccgcataaagtgtaacgccagatgacactttttgtgtaatgacggagttcacatttttaatttagatcaaaggaggaagaataagcagaaaaagcccgccataacagcgggcaggaggatttagaactgataaaccagacctaaagcgacaatatcatcggtagagatgccattggcagcgtagaagctgtcatcttcatccaacaggttgatttta

SEQ ID NO: 111 - DNA, 125 bp, Escherichia coli
tccgcataaagtgtaacgccagatgacactttttgtgtaatgacggagttcacatttttaatttagatcaaaggaggaagaataagcagaaaaagcccgccataacagcgggcaggaggatttag

SEQ ID NO: 112 - DNA, 218 bp, Escherichia coli
  misc_feature (1)...(218): n = A,T,C or G
taatgaccgagttcacatttttaatttanatcaaangaggaaagaataagcngaaaaagcccgccataacagcgggcaggaggatttagaactgataaaccagacctaaagcgacaatatcatcggtagagatgccattggcagcgtanaagctgtcatcttcatccaacaggttgattttatagtcaacgtaggtggacatgtttttattgaaatag

SEQ ID NO: 113 - DNA, 148 bp, Escherichia coli
cgcataaagtgtaacgccagatgacactttttgtgtaatgacggagttcacatttttaatttagatcaaaggaggaagaataagcagaaaaagcccgccataacagcgggcaggaggatttagaactgataaaccagacctaaagcga

SEQ ID NO: 114 - DNA, 193 bp, Escherichia coli
tgcggtattgcgcaggccaaagaaagcaagcgaaggtgtcaggtcgctcatttcgacttcgggccagcgtggcacaaagaccaatggtgaactgccatgacaggtattggccccagcagcggaactcacaaggcaccataacgtcccctccctgataacgctgatactgtggtcgcggttatgccagttggca

SEQ ID NO: 115 - DNA, 117 bp, Escherichia coli
tgccatgacaggtattggccccagcagcggaactcacaaggcaccataacgtcccctccctgataacgctgatactgtggtcgcggttatgccagttggcatcttcacgtaaataga

SEQ ID NO: 116 - DNA, 133 bp, Escherichia coli
taacctgcccgcgcaaacgtgttattcgataaggctttctgaaggggtgatcaagttgcgggttcaggcagctttcataataggcctgaatctccatcatgcgagtgcgatgacgctggtaacgacgccaggc

SEQ ID NO: 117 - DNA, 288 bp, Escherichia coli
taatctagctatgaggaacaaataaaataaaaatattatttttaatactgaagcaacatctttggctgctttcttttttaatattgctggccgattcattttctgatatcggccatttttattgcgggtatcaggccagtttatggttagccattaattccagcgcctgcactaacgcagagtgatccaactggctgccaccgtttgccgcacaggtattaaataactcctggcaggtcgcagtgtttggcaggttcagcgcaagtgctttcgcactttgcagtgcca

SEQ ID NO: 118 - DNA, 246 bp, Escherichia coli
taatttcacgtatcgaataacgttgttttaatctagctatgaggaacaaataaaataaaaatattatttttaatactgaagcaacatctttggctgctttcttttttaatattgctggccgattcattttctgatatcggccatttttattgcgggtatcaggccagtttatggttagccattaattccagcgcctgcactaacgcagagtgatccaactggctgccaccgtttgccgcacaggta

SEQ ID NO: 119 - DNA, 525 bp, Escherichia coli
taatttcacgtatcgaataacgttgttttaatctagctatgaggaacaaataaaataaaaatattatttttaatactgaagcaacatctttggctgctttcttttttaatattgctggccgattcattttctgatatcggccatttttattgcgggtatcaggccagtttatggttagccattaattccagcgcctgcactaacgcagagtgatccaactggctgccaccgtttgccgcacaggtattaaataactcctggcaggtcgcagtgtttggcaggttcagcgcaagtgctttcgcactttgcagtgccaggttgagatctttctggtgcagagcgattttgaagcccggattaaaggtgcgtttaatcatacgctcgccatgaacttccagaatacgtgaggaagcaaagccgcccatcagcgcctggcgcacacgtaccgggtccgcaccggcttttgaagcaaatagcagggcttcagaaaccgcttcaatattgagcgccacgataatctgattt

SEQ ID NO: 120 - DNA, 161 bp, Escherichia coli
  misc_feature (1)...(161): n = A,T,C or G
tcttaatttcacgtatcgaataacgntgntttaatctagctatgaggnacaaataaaataaaaatattatttttaatactgaagcaacatctttggctgctttcttttttaatattgctggccgattcattttctgatatcggccatttttattgcgggta

SEQ ID NO: 121 - DNA, 535 bp, Escherichia coli
  misc_feature (1)...(535): n = A,T,C or G
cagtatcaatcagcgactggcgctgtgcttctgctgcatctactgcgacgctatgctgtgcctcggtatccgtcacccatttctcaccatcccatttatcgtatggcgttaatggggcgatagtcgcgggacgcatacaaacataacccctggatgttatgtgtctatcgagaatcaaagtggaagtccttatgttaagtataagacaggaatcacttataacgataatcagttagtatatgtatctatcactgttgatgataatatcagcacttggttctggagggggtttgttgtgggcaatgatgcatttaagttatcgnctgcagatagaggagatattacaataaacaacgaatcagggcatttgatagtcaataccgcaattctatcaggagatatagtcactctaagaggaggagaaattaggttggtattatagcttgtgcgcgccatgattggcgcgcaatttaaacttagtgctttacatcgctattgncttgatttctttgaattattctataaattaaaaaaa

SEQ ID NO: 122 - DNA, 267 bp, Escherichia coli
ccattttttcaatgaaaattaaaaaggggatttttgagaagggtagaatgtcgtttgtttttttctttattatgtctggtgacgcggggggatagaacgtctgtgcatatagtagtgaatttattcaggtctacattattctctattttggtcagttttatgagttcatttacagccatactcattaaatcatctgttatcgaaaatttatatatgctcatagcagataatattgcttgctgaattatctcttcagaaatatccgct

SEQ ID NO: 123 - DNA, 203 bp, Escherichia coli
ttttttctttattatgtctggtggacgccggggggatagaaccgtctgtgcatatagtagtgaatttattcaggtctacattattctctattttggcagttttatgagttcatttacagccatactcattaaatcatctgttatcgaaaatttatatatgctcatagcagataatattgcttgctgaattatctcttcagaaa

SEQ ID NO: 124 - DNA, 247 bp, Escherichia coli
ccttaatgtgtatgacctggattcatagtatcaattgccattttttcaatgaaaattaaaaaggggatttttgagaagggtagaatgtcgtttgtttttttctttattatgtctggtgacgcggggggatagaacgtctgtgcatatagtagtgaatttattcaggtctacattattctctattttggtcagttttatgagttcatttacagccatactcattaaatcatctgttatcgaaaattta

SEQ ID NO: 125 - DNA, 145 bp, Escherichia coli
aaattaaaaaggggatttttgagaagggtagaatgtcgtttgtttttttctttattatgtctggtgacgcggggggatagaacgtctgtgcatatagtagtgaatttattcaggtctacattattctctattttggtcagtttta

SEQ ID NO: 126 - DNA, 469 bp, Escherichia coli
aatgagaatgattggccttctttatgattttaaggattatgcttctaaaatggcggagaacatggcgaggcttgctgccttacttcattacttcagcggtgatggaggcgatatatctgttaccgggtaatgactccaacttattgatagtgttttatgttcagataatgcccgatgactttgtcatgctgctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaaca

SEQ ID NO: 127 - DNA, 596 bp, Escherichia coli
  misc_feature (1)...(596): n = A,T,C or G
cgatcagttatccctgtgtctgcaacatttccacgagaagctatcattgttatatctaatgctagtcccggattattcaatattagagagtcaaatattctttgtgatgctgtatcgttccaccattttgtcaatgcttttgcagcattatcatctgcttgctgctgtgcagggcttttgggccatggaattggcaaggggaatggtctaggaaaaacttctaaccccagaggatctgtattcgtaactggattcaacggatactgataaaaattccatccccccttcagcccaatcggatcctgagtgatataccgcccctgcagcgggtcataatagcggtggcggttgtaatacaggccggactcctcatcatactgctgccccggcaggcggataagctgctgcagctgatgcgggttctcttcattcagcaggttgccccattcatcgtattctgcgcaccattctgttgcccttccttgctgataagggccagcggcaggccgcgatggtcgcagtggtacangtggatttttcgcgccggcgtgtacaccgggtccatctggttttgcatctgctccacggncangccg

SEQ ID NO: 128 - DNA, 963 bp, Escherichia coli
  CDS (1)...(963)
gtgatgatcaaaacgcgtttttctcgctggctaacgttttttacgttcgccgctgccgtggcgctggcgctaccggcaaaagccaacacctggccgctgccgccagcgggcagtcgtctggttggcgaaaacaaatttcatgtggtggaaaatgacggtggttctctggaagccatcgccaaaaaatacaacgtcggctttctcgctctgttacaggctaaccccggcgttgatccttacgtaccgcgcgcgggcagcgtgttaacgatcccgttgcaaaccctacttccagatgcgccgcgcgaaggcattgtgatcaacattgcggagctgcgtctctattactacccgccgggtaaaaattcggtaaccgtgtatccaataggtattggtcagttaggtggtgacacgctgacaccgacaatggtgaccaccgtttcagacaaacgtgcaaacccaacctggacgccaacggcaaacatccgcgcccgttataaagcacagggaattgagttgcctgcggtagtgccggctggactggataacccaatgggccatcatgcgattcgtctggcggcctatggcggcgtttatttgcttcatggtacgaacgccgatttcggcattggcatgcgggtaagttctggctgtattcgtctgcgggatgacgatatcaaaacactctttagccaggtcaccccaggcaccaaagtgaatatcatcaacactccgataaaagtctctgccgaaccaaacggtgcgcgtctggttgaagtacatcagccgctgtcagagaagattgatgacgatccgcagctgctgccaattacgctgaatagcgcaatgcaatcatttaaagatgcagcacaaactgacgctgaagtgatgcaacatgtgatggatgtccgttccgggatgccggtggatgtccgccgtcatcaagtgagcccacaaacgctgtaa

SEQ ID NO: 129 - DNA, 2187 bp, Escherichia coli
  CDS (1)...(2187)
atgattactcgtattcctcgtagttctttctctgcaaatattaataatacagcccagacaaatgaacaccaaaccctgagtgaattgttttataaagaactcgaggataaattttctggcaaggagctggcgacgcctctattaaaaagcttctcagagaactgtagacaaaatggtcgtcatatctttagcaacaaggattttgtcattaaattttccacgtccgtcttacaagctgataagaaagaaattacgataattaataaaaacgaaaacacgacacttactcaaaccattgccccaatatttgaaaaatacctaatggaaattttacctcaacgctcagacactcttgataaacaagaattaaacctaaaatcagatagaaaagaaaaagaattcccaagaattaaacttaatggtcaatgttattttccggggcgaccccaaaaccgtatagtatgccgacacattgctgcacaatatattaatgatatttatcagaatgttgattacaaaccccatcaagatgattactcttcagctgaaaaatttctcacgcacttcaacaaaaaatgcaaaaaccagactttggcgttggtttccagccgtcctgaggggcgttgcgttgctgcctgcggtgatttcgggctagttatgaaagcatattttgacaagatggaatcaaatggcatcagtgttatggcagccatattactggtggataaccatgctttgacggtccggctaagaataaagaacacaactgaaggatgtacccattacgtggtttcggtttatgatcctaatgtaactaacgataaaataagaattatgagcgaaagcaaagagaatattaaacactattctctgatggattttatgaatgtagattatagcctcctgaaatggtcaaatgatcatgttattaatcaatctgttgcaataattccagcacttccgaaagaacagctattgatgttaaaaggatctgtggatgaaataacccctccattatcacctgcaacgatgaatttgctaatggcaattggtcagaatcaccaacttacgcaactgatgattcaactccagaaaatgccagaactacatagaacagaaatgttgactgcctataatagtattaacctgccaggtttatatttggctataaattatggtaatgcggatatcgttgagactattttcaattcattgtcagaaacaggatatgaaggattactctcgaaaaaaaatctcatgcatattctggaggcaaaagataaaaatggtttttctggattatttttagcgatatcacgtaaggataaaaatgttgtaacctcgattctgaacgccttacctaaactggccgcaacacatcatttagataacgaacaagtgtataaattcctgagtgccaaaaatagaacgtccagccatgttttataccatgttatggcgaatggtgatgccgacatgctgaaaattgttttgaacgcgttacctttgttaattcgcacatgtcatttgactaaagaacaggtactcgatctcctgaaggcaaaggatttttatggttgcccaggactatatctggcgatgcaaaatggacatagcgatatcgtgaaagttattcttgaagcattgcccagcctagcccaggaaattaacatttcagcttccgatattgtagatcttctgaccgctaaaagtcttgcgcgcgacacgggtttgtttatggccatgcagcgcggacacatgaacgttattaatactatttttaacgcattacccactctgtttaatacgtttaaattcgataaaaaaaatatgaagcccctcctcctggcaaataattctaatgaatatcccggtttgttttcagcgatacagcataaacaacaaaatgttgtagagacggtttatcttgctttatctgaccatgcacgcctgtttggatttaccgctgaagatattatggatttttggcaacacaaagccccacaaaaatactctgcctttgagttggcttttgaatttggtcaccgggttattgctgaattaatccttaatacattaaataagatggctgaaagctttggctttacggataaccctcgatacattgcggagaaaaattatatggaagctttactcaaaaaagcatctccccataccgtacgctaa

SEQ ID NO: 130 - DNA, 255 bp, Escherichia coli
  CDS (1)...(255)
atgaccgataaaatccgtactctgcaaggtcgcgttgttagcgacaaaatggagaaatccattgttgttgctatcgaacgttttgtgaaacacccgatctacggtaaattcatcaagcgtacgaccaaactgcacgtacatgacgagaacaacgaatgcggtatcggtgacgtggttgaaatccgcgaatgccgtccgctgtccaagactaaatcctggacgctggttcgcgttgtagagaaagcggttctgtaa

SEQ ID NO: 131 - DNA, 192 bp, Escherichia coli
  CDS (1)...(192)
atgaaagcaaaagagctgcgtgagaagagcgttgaagagctgaacaccgagctgctgaacctgctgcgtgagcagttcaacctgcgtatgcaggctgcaagtggccagctgcaacagtctcacctgttgaagcaagtgcgtcgcgatgtcgcacgcgttaagactttactgaacgagaaggcgggtgcgtaa

SEQ ID NO: 132 - DNA, 411 bp, Escherichia coli
  CDS (1)...(411)
atgttacaaccaaagcgtacaaaattccgtaaaatgcacaaaggccgtaaccgcggtctggcgcagggtacggatgttagcttcggcagcttcggtctgaaagctgttggccgtggtcgtctgactgcccgtcagatcgaagcagcacgtcgtgctatgacccgtgcagttaagcgtcaaggtaagatctggatccgtgtgttcccggacaaaccgatcactgaaaagccgctggcagtgcgtatgggtaaaggtaaaggtaacgtggagtattgggttgccttgattcagccgggtaaagtcctgtatgaaatggacggtgttccggaagagctggcccgtgaagcattcaagctggcagcagcgaaactgccgattaaaaccacctttgtaactaagacggtgatgtaa

SEQ ID NO: 133 - DNA, 702 bp, Escherichia coli
  CDS (1)...(702)
atgggtcagaaagtacatcctaatggtattcgcctgggtattgtaaaaccatggaactctacctggtttgcgaacaccaaagaattcgctgacaacctggacagcgattttaaagtacgtcagtacctgactaaggaactggctaaagcgtccgtatctcgtatcgttatcgagcgtccggctaagagcatccgtgtaaccattcacactgctcgcccgggtatcgttatcggtaaaaaaggtgaagacgtagaaaaactgcgtaaggtcgtagcggacatcgctggcgttcctgcacagatcaacatcgccgaagttcgtaagcctgaactggacgcaaaactggttgctgacagcatcacttctcagctggaacgtcgcgttatgttccgtcgtgctatgaagcgtgctgtacagaacgcaatgcgtctgggcgctaaaggtattaaagttgaagttagcggccgtctgggcggcgcggaaatcgcacgtaccgaatggtaccgcgaaggtcgcgtaccgctgcacactctgcgtgctgacatcgactacaacacctctgaagcgcacaccacttacggtgtaatcggcgttaaagtgtggatcttcaaaggcgagatcctgggtggtatggctgctgttgaacaaccggaaaaaccggctgctcagcctaaaaagcagcagcgtaaaggccgtaaataa

SEQ ID NO: 134 - DNA, 333 bp, Escherichia coli
  CDS (1)...(333)
atggaaactatcgctaaacatcgccatgctcgttcttctgctcagaaggttcgccttgttgctgacctgattcgcggtaagaaagtgtcgcaggctctggatattttgacctacaccaacaagaaagcggctgtactggtcaagaaagttctggaatctgccattgctaacgctgaacacaacgatggcgctgacattgacgatctgaaagttacgaaaattttcgtagacgaaggcccgagcatgaagcgcattatgccgcgtgcaaaaggtcgtgcagatcgcatcctgaagcgcaccagccacatcactgtggttgtgtccgatcgctga

SEQ ID NO: 135 - DNA, 279 bp, Escherichia coli
  CDS (1)...(279)
atgccacgttctctcaagaaaggtccttttattgacctgcacttgctgaagaaggtagagaaagcggtggaaagcggagacaagaagcccctgcgcacttggtcccgtcgttcaacgatctttcctaacatgatcggtttgaccatcgctgtccataatggtcgtcagcacgttccggtatttgtaaccgacgaaatggttggtcacaaactgggtgaattcgcaccgactcgtacttatcgcggccacgctgctgataaaaaagcgaagaagaaataa

SEQ ID NO: 136 - DNA, 822 bp, Escherichia coli
  CDS (1)...(822)
atggcagttgttaaatgtaaaccgacatctccgggtcgtcgccacgtagttaaagtggttaaccctgagctgcacaagggcaaaccttttgctccgttgctggaaaaaaacagcaaatccggtggtcgtaacaacaatggccgtatcaccactcgtcatatcggtggtggccacaagcaggcttaccgtattgttgacttcaaacgcaacaaagacggtatcccggcagttgttgaacgtcttgagtacgatccgaaccgttccgcgaacatcgcgctggttctgtacaaagacggtgaacgccgttacatcctggcccctaaaggcctgaaagctggcgaccagattcagtctggcgttgatgctgcaatcaaaccaggtaacaccctgccgatgcgcaacatcccggttggttctactgttcataacgtagaaatgaaaccaggtaaaggcggtcagctggcacgttccgctggtacttacgttcagatcgttgctcgtgatggtgcttatgtcaccctgcgtctgcgttctggtgaaatgcgtaaagtagaagcagactgccgtgcaactctgggcgaagttggcaatgctgagcatatgctgcgcgttctgggtaaagcaggtgctgcacgctggcgtggtgttcgtccgaccgttcgcggtaccgcgatgaacccggtagaccacccacatggtggtggtgaaggtcgtaactttggtaagcacccggtaactccgtggggcgttcagaccaaaggtaagaagacccgcagcaacaagcgtactgataaattcatcgtacgtcgccgtagcaaataa

SEQ ID NO: 137 - DNA, 303 bp, Escherichia coli
  CDS (1)...(303)
atgattcgtgaagaacgtctgctgaaggtgctgcgtgcaccgcacgtttctgaaaaagcgtctactgcgatggaaaaatccaacaccatcgtactcaaagttgctaaagacgcgaccaaagcagaaatcaaagctgctgtgcagaaactgtttgaagtcgaagtcgaagtcgttaacaccctggtagttaaagggaaagttaaacgtcacggacagcgtatcggtcgtcgtagcgactggaaaaaagcttacgtcaccctgaaagaaggccagaatctggacttcgttggcggcgctgagtaa

SEQ ID NO: 138 - DNA, 606 bp, Escherichia coli
  CDS (1)...(606)
atggaattagtattgaaagacgcgcagagcgcgctgactgtttccgaaactaccttcggtcgtgatttcaacgaagcgctggttcaccaggttgttgttgcttatgcagctggtgctcgtcagggtactcgtgctcagaagactcgtgctgaagtaactggttccggtaaaaaaccgtggcgccagaaaggcaccggccgtgcgcgttctggttctatcaagagcccgatctggcgttctggtggcgtgacctttgctgctcgtccgcaggaccacagtcaaaaagttaacaagaagatgtaccgcggcgcgctgaaaagcatcctgtccgaactggtacgtcaggatcgtctgatcgttgtcgagaagttctctgtagaagcgccgaaaactaagctgctggcacagaaactgaaagacatggctctggaagatgtgctgatcatcaccggtgagctggacgaaaacctgttcctggctgcgcgcaacctgcacaaggttgacgtacgcgatgcaactggtatcgacccggttagcctgatcgccttcgacaaagtcgtaatgactgctgatgctgttaagcaagttgaggagatgctggcatga

SEQ ID NO: 139 - DNA, 630 bp, Escherichia coli
  CDS (1)...(639)
atgattggtttagtcggtaaaaaagtgggtatgacccgtatcttcacagaagacggcgtttctatcccagtaaccgtaatcgaagttgaagcaaaccgcgttactcaggttaaagacctggctaacgatggctaccgtgctattcaggtgaccaccggtgctaaaaaagctaaccgtgtgaccaagcctgaagctggccacttcgctaaagctggcgtagaagctggccgtggtctgtgggaattccgcctggctgaaggcgaagagttcactgtaggtcagagcattagcgttgaactgtttgctgacgttaaaaaagttgacgtaactggcacctctaaaggtaaaggtttcgcaggtaccgttaagcgctggaacttccgtacccaggacgctactcacggtaactccttgtctcaccgcgttccgggttctatcggtcagaaccagactccgggcaaagtgttcaaaggcaagaaaatggcaggtcagatgggtaacgaacgtgtaaccgttcagagccttgacgtagtacgcgttgacgctgagcgcaacctgctgctggttaaaggtgctgtcccgggtgcaaccggtagcgacctgatcgttaaaccagctgtgaaggcgtaa

SEQ ID NO: 140 - DNA, 312 bp, Escherichia coli
  CDS (1)...(312)
atgcagaaccaaagaatccgtatccgcctgaaagcgtttgatcatcgtctgatcgatcaagcaaccgcggaaatcgtcgagactgccaagcgcactggtgcgcaggtccgtggtccgatcccgctgccgacacgcaaagagcgcttcactgttctgatctccccgcacgtcaacaaagacgcgcgcgatcagtacgaaatccgtactcacttgcgtctggttgacatcgttgagccaaccgagaaaaccgttgatgctctgatgcgtctggatctggctgccggtgtagacgtgcagatcagcctgggttaa

SEQ ID NO: 141 - DNA, 4710 bp, Escherichia coli
  CDS (1)...(4710)
gtgaacacaatacacttgcgctgtctcttcaggatgaatcccctggtctggtgcctgtgggctgatgttgcagcaaagctaaggtcgcttaaacgctactcagtattcacttttcagaggatgaaatttatgaacaggaccagtccctattattgtcgccgctcagtactttccttattgatatctgccttgatatatgccccgcccgggatggctgccttcactactaatgttattggtgtggtaaacgatgagactgtagatggcaaccaaaaagtggatgaacgaggtacaacaaataacactcatattatcaaccatggccagcagaatgttcatggcggggtatctaatggaagtcttattgaatctggtggatatcaagatataggaagtcataacaattttgtggggcaggctaataatacaaccattaacggtggcagacagtcaattcatgacgggggtatttccacaggtacgacaatcgagagtggcaatcaggacgtttataaagggggtatcagcaatggaacgacaattaagggcggtgcttcacgcgtagagggagggagtgcgaatggaatactcattgatggtggtagccagatagtaaaagttcaagggcatgctgatggtacaacgataaataagtctggctctcaggacgtagtacaaggaagtctggcaacgaacacaaccataaatggtggtcgacagtatgttgaacagagcacagtagaaacaacaaccattaaaaatggcggtgagcaaagagtatatgagagccgtgcgctggacacgacgattgaaggcggaactcagtctctgaatagtaagtcaacggcaaaaaatacgcatatctattctggtggcacgcaaattgttgataacaccagcacctcggatgttattgaagtttattctggtggcgtgcttgatgttaggggtggtacggcaacaaatgttacccagcacgatggtgcaattttaaaaactaacactaacggtacgacggtgagcggtacgaatagtgaaggtgcattctccatccacaatcacgtggcagacaatgtgttgctggaaaacggtggtcatttagacataaacgcatatggttcggcaaacaagacgattattaaagataaaggaacaatgtcagttttaaccaatgctaaagctgatgcgacccgaatagataatggcggggttatggatgttgcaggaaacgcgacaaataccataattaatggtggcacacagaatattaataattatggcatagccacaggcaccaatatcaacagcggaacgcaaaatatcaaaagcggcgggaaagctgacacaacaattatatcctccgggagccggcaggttgttgagaaagatggtacggcaattggcagcaatattagcgccggaggctcgctgattgtctataccggcggtattgcacatggggttaaccaggagacgggcagtgctttagttgccaacacgggtgcagggactgatatcgaaggatacaacaagctctctcacttcactattaccggaggggaggctaattatgttgtgctggaaaataccggcgaactgacggtagtggctaaaacctcggcgaaaaatactaccattgatactggcggtaagctgattgtccagaaggaggctaaaacagatagcaccagacttaataatggcggcgttctggaggttcaggacggtggtgaggctaagcatgttgagcaacaatccggcggcgcattaattgcttccacgacctccggaacacttatcgaaggaaccaacagttatggtgatgctttctacatcaggaattcagaagctaaaaatgtagtgctggaaaacgctggctcattaacagtcgtcactggttcccgcgcagttgacacgattattaatgccaacggcaaaatggatgtttatggaaaagatgttggcactgtactcaatagtgctggcacccaaacaatatatgccagtgccacttctgataaagcaaatatcaaaggtggcaagcaaacggtatatggtttagccactgaagcaaatatcgaaagtggtgaacaaattgttgatggtgggtcaacagagaaaacacacatcaatggtggcacgcaaaccgttcagaattatggtaaggcaatcaataccgatatcgtctctggcctacaacaaattatggcaaacgggacagcggaaggttccattattaatgggggttcacaggtagttaatgagggcggcctggctgaaaactcggtgcttaatgacggcggcacactcgatgtgcgggagaaaggcagcgcaacggggatacagcagagtagccagggcgctttggttgcaaccaccagggcgacgcgggtcacaggaacacgcgcggatggcgtcgcgttcagcatcgagcagggtgcggcgaacaatatcctgctggcaaatggcggcgtgttaaccgtggagtcagacacctcttctgacaaaacacaggtcaatatgggcggacgggagatcgtcaaaacaaaagccactgcgacaggcacgacgctcaccggcggtgaacaaattgtcgagggtgtggcgaatgagacaacaattaacgacggcggaatacaaacagtttcagctaacggagaggcaataaaaacaaagatcaatgaaggcggtacgctgacagtcaacgataatggcaaagcgacagatatcgtccagaacagcggtgccgctctccagacgagcacggctaacggtattgaaatcagcggtactcaccagtacggtactttttccatttccggcaatttagcgaccaatatgttgctggaaaatggcggtaatttattggtattagcaggtaccgaagctcgcgactccacggttggcaagggtggggcaatgcaaaacctgggtcaggactccgccacaaaggttaactctggcgggcaatatacccttgggcggtcaaaagatgagtttcaggctctggcccgggcagaagatctccaggtcgctggcggtacggcaatcgtctacgcaggtacgctggcggatgcatcggtcagtggcgcgacaggaagcctgtcgttaatgacgccacgggataatgttacgccagttaaactcgaaggggcggtccggattaccgatagcgcgacattgactctgggaaatggcgtcgataccacgcttgccgacctgacggctgccagccggggcagtgtctggcttaacagcaataattcctgtgcaggtaccagcaactgcgaatatagagtaaacagtttgctactcaacgacggtgatgtttatttgtcagcacaaacagcagcgcctgccacaactaacggtatctacaatacgctgacaaccaatgaactttccggtagcggtaatttctacctgcataccaacgttgcaggctcccggggcgatcaactggtcgtcaacaacaacgccactggtaattttaaaatctttgttcaggataccggcgtcagcccacagtctgacgacgcgatgacgctggtgaaaacagggggaggggatgcttcgtttacgctgggcaataccggcggtttcgttgatcttgggacctatgagtatgtcctgaaaagtgacggcaacagcaactggaacctgaccaatgatgtcaaacccaacccggaccccatcccaaatccaaagccagacccaaaacccgatccaaagccagacccaaatccaaaaccagaccctactcccgatccaacgccgacacccgttccggagaaacgcattacgccttctacggcagccgtactcaatatggcagcaacattaccgttggtatttgatgctgagctaaacagtattcgcgagcggttgaacataatgaaagcgagtccacacaacaataatgtctggggggcgacgtataacacccgtaataatgtcaccaccgatgcgggtgccgggtttgagcagacgctgaccggaatgacagtggggatcgacagccgtaatgatattcctgaaggaattaccacgctaggcgcttttatgggctattcccattcacatatcggttttgatcgcggaggacatggcagtgtgggcagttattctctgggcggctatgccagttgggaacatgaaagtggtttctatctggacggtgtcgtgaagctgaaccgttttaaaagtaacgtagcaggtaaaatgagcagcggtggagccgccaatggcagttaccacagcaacgggctgggcggtcacattgaaaccgggatgcgatttaccgatggtaactggaacctgacgccgtatgcatcgttaacggggttcaccgctgataaccccgaatatcatttatccaatggcatgaaatcgaaatcagtcgatacccgcagtatatatcgtgaactgggcgcaacgctgagttacaacatgcgtctggggaacggtatggaagttgagccgtggctgaaggcggctgtgcgcaaagaatttgtcgatgataaccgggtgaaagtgaatagtgacggtaatttcgtcaattatttgtcgggcagacgtggaatataccaggcaggtattaaagcctcattcagcagtacgttaagcgggcatcttggggtggggtatagccatagtgccggtgtggaatccccgtggaacgcggtagctggtgtgaactggtcgttctga

SEQ ID NO: 142 - DNA, 117 bp, Escherichia coli
  CDS (1)...(117)
atgaaagttcgtgcttccgtcaagaaattatgccgtaactgcaaaatcgttaagcgtgatggtgtcatccgtgtgatttgcagtgccgagccgaagcataaacagcgccaaggctga

SEQ ID NO: 143 - DNA, 1332 bp, Escherichia coli
  CDS (1)...(1332)
atggctaaacaaccgggattagattttcaaagtgccaaaggtggcttaggcgagctgaaacgcagactgctgtttgttatcggtgcgctgattgtgttccgtattggctcttttattccgatccctggtattgatgccgctgtacttgccaaactgcttgagcaacagcgaggcaccatcattgagatgtttaacatgttctctggtggtgctctcagccgtgcttctatctttgctctggggatcatgccgtatatttcggcgtcgatcattatccagctgctgacggtggttcacccaacgttggcagaaattaagaaagaaggggagtctggtcgtcgtaagatcagccagtacacccgctacggtactctggtgctggcaatattccagtcgatcggtattgctaccggtctgccgaatatgcctggtatgcaaggcctggtgattaacccgggctttgcattctacttcaccgctgttgtaagtctggtcacaggaaccatgttcctgatgtggttgggcgaacagattactgaacgaggtatcggcaacggtatttcaatcattatcttcgccggtattgtcgcgggactcccgccagccattgcccatactatcgagcaagcgcgtcaaggcgacctgcacttcctcgtgttgctgttggttgcagtattagtatttgcagtgacgttctttgttgtatttgttgagcgtggtcaacgccgcattgtggtaaactacgcgaaacgtcagcaaggtcgtcgtgtctatgctgcacagagcacacatttaccgctgaaagtgaatatggcgggggtaatcccggcaatcttcgcttccagtattattctgttcccggcgaccatcgcgtcatggttcgggggcggtactggttggaactggctgacaacaatttcgctgtatttgcagcctgggcaaccgctttatgtgttactctatgcgtctgcaatcatcttcttctgtttcttctacacggcgttggttttcaacccgcgtgaaacagcagataacctgaagaagtccggtgcatttgtaccaggaattcgtccgggagagcaaacggcgaagtatatcgataaagtaatgacccgcctgaccctggttggtgcgctgtatattacctttatctgcctgatcccggagttcatgcgtgatgcaatgaaagtaccgttctacttcggtgggacctcactgcttatcgttgttgtcgtgattatggactttatggctcaagtgcaaactctgatgatgtccagtcagtatgagtctgcattgaagaaggcgaacctgaaaggctacggccgataa

SEQ ID NO: 144 - DNA, 435 bp, Escherichia coli
  CDS (1)...(435)
atgcgtttaaatactctgtctccggccgaaggctccaaaaaggcgggtaaacgcctgggtcgtggtatcggttctggcctcggtaaaaccggtggtcgtggtcacaaaggtcagaagtctcgttctggcggtggcgtacgtcgcggtttcgagggtggtcagatgcctctgtaccgtcgtctgccgaaattcggcttcacttctcgtaaagcagcgattacagccgaaattcgtctgtctgacctggctaaagtagaaggcggtgtagtagacctgaacacgctgaaagcggctaacattatcggtatccagatcgagttcgcgaaagtgatcctggctggcgaagtaacgactccggtaactgttcgtggcctgcgtgttactaaaggcgctcgtgctgctatcgaagctgctggcggtaaaatcgaggaataa

SEQ ID NO: 145 - DNA, 180 bp, Escherichia coli
  CDS (1)...(180)
atggcaaagactattaaaattactcaaacccgcagtgcaatcggtcgtctgccgaaacacaaggcaacgctgcttggcctgggtctgcgtcgtattggtcacaccgtagagcgcgaggatactcctgctattcgcggtatgatcaacgcggtttccttcatggttaaagttgaggagtaa

SEQ ID NO: 146 - DNA, 504 bp, Escherichia coli
  CDS (1)...(504)
atggctcacatcgaaaaacaagctggcgaactgcaggaaaagctgatcgcggtaaaccgcgtatctaaaaccgttaaaggtggtcgtattttctccttcacagctctgactgtagttggcgatggtaacggtcgcgttggttttggttacggtaaagcgcgtgaagttccagcagcgatccagaaagcgatggaaaaagcccgtcgcaatatgattaacgtcgcgctgaataacggcactctgcaacaccctgttaaaggtgttcacacgggttctcgcgtattcatgcagccggcttccgaaggtaccggtatcatcgccggtggtgcaatgcgcgccgttctggaagtcgctggggttcataacgttctggctaaagcctatggttccaccaacccgatcaacgtggttcgtgcaactattgatggcctggaaaatatgaattctccagaaatggtcgctgccaagcgtggtaaatccgttgaagaaattctggggaaataa

SEQ ID NO: 147 - DNA, 354 bp, Escherichia coli
  CDS (1)...(354)
atggataagaaatctgctcgtatccgtcgtgcgacccgcgcacgccgcaagctccaggagctgggcgcaactcgcctggtggtacatcgtaccccgcgtcacatttacgcacaggtaattgcaccgaacggttctgaagttctggtagctgcttctactgtagaaaaagctatcgctgaacaactgaagtacaccggtaacaaagacgcggctgcagctgtgggtaaagctgtcgctgaacgcgctctggaaaaaggcatcaaagatgtatcctttgaccgttccgggttccaatatcatggtcgtgtccaggcactggcagatgctgcccgtgaagctggccttcagttctaa

SEQ ID NO: 148 - DNA, 534 bp, Escherichia coli
  CDS (1)...(534)
atgtctcgtgttgctaaagcaccggtcgttgttcctgccggcgttgacgtaaaaatcaacggtcaggttattacgatcaaaggtaaaaacggcgagctgactcgtactctcaacgatgctgttgaagttaaacatgcagataataccctgaccttcggtccgcgtgatggttacgcagacggttgggcacaggctggtaccgcgcgtgccctgctgaactcaatggttatcggtgttaccgaaggcttcactaagaagctgcagctggttggtgtaggttaccgtgcagcggttaaaggcaatgtgattaacctgtctctgggtttctctcatcctgttgaccatcagctgcctgcgggtatcactgctgaatgtccgactcagactgaaatcgtgctgaaaggcgctgataagcaggtgatcggccaggttgcagcggatctgcgcgcctaccgtcgtcctgagccttataaaggcaagggtgttcgttacgccgacgaagtcgtgcgtaccaaagaggctaagaagaagtaa

SEQ ID NO: 149 - DNA, 393 bp, Escherichia coli
  CDS (1)...(393)
atgagcatgcaagatccgatcgcggatatgctgacccgtatccgtaacggtcaggccgcgaacaaagctgcggtcaccatgccttcctccaagctgaaagtggcaatcgccaacgtgctgaaggaagaaggttttattgaagattttaaagttgaaggcgacaccaagcctgaactggaacttactctgaagtatttccagggcaaagctgttgtagaaagcattcagcgtgtcagccgcccaggtctgcgcatctataaacgtaaagatgagctgccgaaagttatggcgggtctgggtatcgcagttgtttctacctctaaaggtgttatgactgatcgtgcagcgcgccaggctggtcttggtggcgaaattatctgctacgtagcctaa

SEQ ID NO: 150 - DNA, 306 bp, Escherichia coli
  CDS (1)...(306)
atggctaagcaatcaatgaaagcacgcgaagtaaaacgcgtagctttagctgataaatacttcgcgaaacgcgctgaactgaaagcgatcatctctgatgtgaacgcttccgacgaagatcgttggaacgctgttctcaagctgcagactctgccgcgtgattccagcccgtctcgtcagcgtaaccgctgccgtcaaacaggtcgtccgcatggtttcctgcggaagttcgggttgagccgtattaaggtccgtgaagccgctatgcgcggtgaaatcccgggtctgaaaaaggctagctggtaa

SEQ ID NO: 151 - DNA, 540 bp, Escherichia coli
  CDS (1)...(540)
atggcgaaactgcatgattactacaaagacgaagtagttaaaaaactcatgactgagtttaactacaattctgtcatgcaagtccctcgggtcgagaagatcaccctgaacatgggtgttggtgaagcgatcgctgacaaaaaactgctggataacgcagcagcagacctggcagcaatctccggtcaaaaaccgctgatcaccaaagcacgcaaatctgttgcaggcttcaaaatccgtcagggctatccgatcggctgtaaagtaactctgcgtggcgaacgcatgtgggagttctttgagcgcctgatcactattgctgtacctcgtatccgtgacttccgtggcctgtccgctaagtctttcgacggtcgtggtaactacagcatgggtgtccgtgagcagatcatcttcccagaaatcgactacgataaagtcgaccgcgttcgtggtttggatattaccattaccactactgcgaaatctgacgaagaaggccgcgctctgctggctgcctttgacttcccgttccgcaagtaa

SEQ ID NO: 152 - DNA, 315 bp, Escherichia coli
  CDS (1)...(315)
atggcagcgaaaatccgtcgtgatgacgaagttatcgtgttaaccggtaaagataaaggtaaacgcggtaaagttaagaatgtcctgtcttccggcaaggtcattgttgaaggtatcaacctggttaagaaacatcagaagccggttccggccctgaaccaaccgggtggcatcgttgaaaaagaagccgctattcaggtttccaacgtagcaatcttcaatgcggcaaccggcaaggctgaccgtgtaggctttagattcgaagacggtaaaaaagtccgtttcttcaagtctaacagcgaaactatcaagtaa

SEQ ID NO: 153 - DNA, 372 bp, Escherichia coli
  CDS (1)...(372)
atgatccaagaacagactatgctgaacgtcgccgacaactccggtgcacgtcgcgtaatgtgtatcaaggttctgggtggctcgcaccgtcgctacgcaggcgtaggcgacatcatcaagatcaccatcaaagaagcaattccgcgtggtaaggtcaaaaaaggtgatgtgctgaaggcggtagtggtgcgcaccaagaagggtgttcgtcgcccggacggttctgtcattcgcttcgatggtaatgcttgtgttcttctgaacaacaacagcgagcagcctatcggtacgcgtatttttgggccggtaactcgtgagcttcgtagtgagaagttcatgaaaattatctctctggcaccagaagtactctaa

SEQ ID NO: 154 - DNA, 1191 bp, Escherichia coli
  CDS (1)...(1191)
atgaaaataaaaacaggtgcacgcatcctcgcattatccgcattaacgacgatgatgttttccgcctcggctctcgccaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcgaaagagttcctcgaaaactatctgctgactgatgaaggtctggaagcggttaataaagacaaaccgctgggtgccgtagcgctgaagtcttacgaggaagagttggcgaaagatccacgtattgccgccaccatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactcgtatcaccaagtaa

SEQ ID NO: 155 - DNA, 1545 bp, Escherichia coli
  CDS (1)...(1545)
atggatgtcattaaaaagaaacattggtggcaaagcgacgcgctgaaatggtcagtgctaggtctgctcggcctgctggtgggttaccttgttgttttaatgtacgcacaaggggaatacctgttcgccattaccacgctgatattgagttcagcggggctgtatattttcgccaatcgtaaagcctacgcctggcgctatgtttacccgggaatggctggaatgggattattcgtcctcttccctctggtctgcaccatcgccattgccttcaccaactacagcagcactaaccagctgacttttgaacgtgcgcaggaagtgttgttagatcgctcctggcaagcaggcaaaacctataactttggtctttacccggcgggcgatgagtggcaactggcgctcagcgacggcgaaaccggcaaaaattacctctccgacgcttttaaatttggcggcgagcaaaaactgcaactgaaagaaacgaccgcccagcccgaaggcgaacgcgcgaatctgcgcgtgattacccagaatcgtcaggcgctgagtgacattaccgccattctgccggatggcaacaaagtgatgatgagctccctgcgccagttttctggcacgcagccgctctacacactcgacggtgacggcacgttgacgaataatcagagcggcgtgaaatatcgtccgaataaccaaattggcttttaccagtccattaccgccgacggcaactggggtgatgaaaagctaagccccggttacaccgtgaccaccggctggaaaaactttacccgcgtctttaccgacgaaggcattcagaaaccgttcctcgccattttcgtctggaccgtggtgttctcgctgatcactgtctttttaacggtggcggtcggcatggttctggcgtgtctggtgcagtgggaagcgttgcgcggcaaagcggtctatcgcgtcctgctgattctgccctacgcggtgccatcgttcatttcaatcttgattttcaaagggttgtttaaccagagcttcggtgaaatcaacatgatgttgagcgcgctgtttggcgtgaagcccgcctggttcagcgatccgaccaccgcccgcacgatgctaattatcgtcaatacctggctgggttatccgtacatgatgatcctctgcatgggcttgctgaaagcgattccggacgatttgtatgaagcctcagcaatggatggcgcaggtccgttccagaacttctttaagattacgctgccgctgctgattaaaccgctgacgccgctgatgatcgccagcttcgcctttaactttaacaacttcgtgctgattcaactgttaaccaacggcggcccggatcgtcttggcacgaccacgccagccggttataccgacctgcttgttaactacacctaccgcatcgcttttgaaggcggcgggggtcaggacttcggtctggcggcagcaattgccacgctgatcttcctgctggtgggtgcgctggcgatagtgaacctgaaagccacgcgaatgaagtttgattaa

SEQ ID NO: 156 - DNA, 891 bp, Escherichia coli
  CDS (1)...(891)
atggcaatggtccaaccgaaatcgcaaaaagctcgtttatttattactcacctgctactgctactttttatcgcagcgattatgttcccgctgctgatggtcgtcgctatctcgctgcgtcagggaaactttgcgaccggcagcctgatcccggagcaaatctcctgggatcactggaaactggcgttaggttttagcgttgaacaggctgatggtcgcattacgccaccgccattcccggtactgctgtggctgtggaactcggtaaaggtcgccgggatttccgcgattggcattgtggcgctctccaccacctgcgcctacgctttcgcccgtatgcgctttccaggcaaagcgacgctgctgaaaggaatgctgattttccagatgttcccggcagtactttcactggtcgcgttgtatgcgttgtttgatcgtctgggtgagtacattccattcattggcctgaatactcacggcggcgtaattttcgcgtatctgggtgggattgcgctgcatgtctggaccatcaaaggctatttcgaaaccatcgacagttcgctggaagaagctgctgcgctggatggtgcgacaccgtggcaggccttccgccttgtcctgttgccgctgtcagtaccgattctggcggtggtattcatcctgtcgtttatcgctgccattactgaagttccggtcgcgtcgctgttactgcgtgacgtaaacagctacaccctggccgtggggatgcagcaatacctcaacccgcaaaactacctgtggggtgactttgccgccgctgccgtgatgtctgcattaccgatcaccatcgtcttcttgctggctcaacgctggctggtcaacggcctgacggcaggtggtgtgaaaggttaa

SEQ ID NO: 157 - DNA, 2022 bp, Escherichia coli
  CDS (1)...(2022)
atgcgtctaaaccccggccaacaacaagctgtcgaattcgttaccggcccctgcctggtgctggcgggcgcgggttccggtaaaactcgtgttatcaccaataaaatcgcccatctgatccgcggttgcggttatcaggcgcggcacattgcggcggtgacctttactaataaagcagcgcgcgagatgaaagagcgtgtagggcagacgctggggcgcaaagaggcgcgtgggctgatgatctccactttccatacgttggggctggatatcatcaaacgcgagtatgcggcgcttgggatgaaagcgaacttctcgttgtttgacgataccgatcagcttgctttgcttaaagagttgaccgaggggctgattgaagatgacaaagttctcctgcaacaactgatttcgaccatctctaactggaagaatgatctcaaaacaccgtcccaggcggcagcaagtgcgattggcgagcgggaccgtatttttgcccattgttatgggctgtatgatgcacacctgaaagcctgtaacgttctcgacttcgatgatctgattttattgccgacgttgctgctgcaagccaatgaagaagtccgcaagcgctggcagaacaaaattcgctatctgctggtggatgagtatcaggacaccaacaccagccagtatgagctggtgaaactgctggtgggcagccgcgcgcgctttaccgtggtgggtgacgatgaccagtcgatctactcctggcgcggtgcacgtccgcaaaacctggtgctgctgagtcaggattttccggcgctgaaggtgattaagcttgagcagaactatcgctcttccgggcgtattctgaaagcggcgaacatcctgatcgccaataacccgcacgtctttgaaaagcgtctgttctccgaactgggttatggcgcggagctaaaagtattaagcgcgaataacgaagaacatgaggctgagcgcgttactggcgagctgatcgcccatcacttcgtcaataaaacgcagtacaaagattacgccattctttatcgcggtaaccatcagtcgcgggtgtttgaaaaattcctgatgcaaaaccgcatcccgtacaaaatatctggtggtacgtcgtttttctctcgtcctgaaatcaaggacttgctggcttatctgcgcgtgctgactaacccggacgatgacagcgcatttctgcgtatcgttaacacgccgaagcgagagattggcccggctacgctgaaaaagctgggtgagtgggcgatgacgcgcaataaaagcatgtttaccgccagctttgatatgggcctgagtcagacgcttagcggacgtggttatgaagcattgacccgcttcactcactggttggcagaaatccagcgtctggcggagcgggagccgattgccgcggtgcgtgatctgatccatggcatggattatgaatcctggctgtacgaaacatcgcccagcccgaaagccgccgaaatgcgcatgaagaacgtcaaccaactgtttagctggatgacggagatgctggaaggcagtgaactggatgagccgatgacgctcacccaggtggtgacgcgctttactttgcgcgacatgatggagcgtggtgagagtgaagaagagctggatcaggtgcaactgatgactctccacgcgtcgaaagggctggagtttccttatgtctacatggtcggtatggaagaagggtttttgccgcaccagagcagcatcgatgaagataatatcgatgaggagcggcggctggcctatgtcggcattacccgcgcccagaaggaattgacctttacgctgtgtaaagaacgccgtcagtacggcgaactggtgcgcccggagccgagccgctttttgctggagctgccgcaggatgatctgatttgggaacaggagcgcaaagtggtcagcgccgaagaacggatgcagaaagggcaaagccatctggcgaatctgaaagcgatgatggcggcaaaacgagggaaataa

SEQ ID NO: 158 - DNA, 1212 bp, Escherichia coli
  CDS (1)...(1212)
atgatggttacagttgtcagcaattattgtcaattatctcaaacgcaactcagtcagacatttgcagaaaaatttactgtgaccgaggaattactgcagtctttaaaaaaaacagcgttatccggagatgaagaaagcattgagttactgcataatattgcgttaggttatgataaatttgggaaagaagctgaagatattctttaccatattgttagaaccccaacaaatgagaccctatcgattatccgacttatcaaaaatgcttgtttaaaattatataatctggcacatatcgcaaccaactcccccctcaaatcacatgattcagatgatctcctgttcaaaaaactattctccccttcgaaattaatgacaattatcggtgatgaaattcctcttatatctgaaaaacagtcgctttcaaaggtgcttttaaatgatgagaataatgaactgagtgatggtacaaacttctgggataaaaatcgtcaattaaccacagatgaaatagcttgctatcttcagaagatcgccgctaatgcaaaaaatactcaagtcaattatcctactggtctctacgtcccctactccaccagaactcacctggaagacgctctcaatgaaaatattaagagcgatccatcatggccgaatgaagtccagttattccccataaatactggcggacactggatattagtttcgctacagaaaatagtaaataaaaaaaataataaactacaaataaaatgcgtcatattcaactcattgcgtgcactaggctatgataaagaaaattcacttaagcgtgtcattaatagttttaattctgaactcatgggagaaatgtcgaataataatataaaagttcatttaaatgaaccagagataatatttttacatgccgatcttcagcaatacttaagccaaagttgcggtgcatttgtgtgcatggcagcccaggaagtgattgaacaaagggaaagcaattctgacagcgccccctatacgttattaaaaaaccatgctgacagatttaaaaaatattcagcagaagagcagtacgaaattgattttcaacatcgactggcaaacagaaattgttatttagataaatatggcgatgcaaatatcaatcattattatagaaacttagaaataaaacactcacaacccaaaaatagagcatccggcaaaagagtgagttaa

SEQ ID NO: 159 - DNA, 891 bp, Escherichia coli
  CDS (1)...(891)
atgatgtttaagcaatacctgcaagtaacgaaaccaggcatcatctttggcaacctgatctcggtgattgggggattcctgctggcctcaaagggcagcattgattatcccctgtttatctacacgctggttggggtgtcactggttgtggcgtcgggttgtgtgtttaacaactacatcgacagggatatcgacagaaagatggaaaggacgaagaatcgggtgctggtgaaaggcctgatctctcctgctgtctcgctggtgtacgccacgttgctgggtattgctggctttatgctgctgtggtttggcgcgaatccgctggcctgctggctgggggtgatgggctttgtggtttatgtcggcgtttatagcctgtacatgaaacgccactctgtctacggcacgttgattggttcgctctccggcgctgcgccgccggtgatcggctactgtgcggtaaccggtgagttcgatagcggcgcagcgatcctgctggctatcttcagcctgtggcagatgcctcactcctatgccatcgccattttccgctttaaggattaccaggcggcaaacattccggtattgccagtggtaaaaggcatttcggtggcgaagaatcacatcacgctgtatatcatcgcctttgccgttgccacgctgatgctctctcttggcggttacgctgggtataaatatctggtggtcgccgcggcggttagcgtctggtggttaggtatggctctgcgcggttataaagttgctgatgacagaatctgggcgcgcaagctgttcggcttctctatcatcgccatcactgccctctcggtgatgatgtccgttgattttatggtaccggactcgcatacgctgctggctgctgtgtggtaa

SEQ ID NO: 160 - DNA, 948 bp, Escherichia coli
  CDS (1)...(948)
atgagactcaggaaatacaataaaagtttgggatggttgtcattatttgcaggcactgtattgctcagtggctgtaattctgcgctgttagatcccaaaggacagattggtctggagcaacgttcactgatactgacggcatttggcctgatgttgattgtcgttattcccgcaatcttgatggctgttggtttcgcctggaagtaccgtgcgagcaataaagatgctaagtacagcccgaactggtcacactccaataaagtggaagctgtggtctggacggtacctatcttaatcatcatcttccttgcagtactgacctggaaaaccactcacgctcttgagcctagcaagccgctggcacacgacgagaagcccattaccatcgaagtggtttccatggactggaaatggttcttcatctacccggaacagggcattgctaccgtgaatgaaatcgctttcccggcgaacactccggtgtacttcaaagtgacctccaactccgtgatgaactccttcttcattccgcgtctgggtagccagatttatgccatggccggtatgcagactcgcctgcatctgatcgccaacgaacccggcacttatgacggtatctccgccagctacagcggcccgggcttctcaggcatgaagttcaaagctattgcaacaccggatcgcgccgcattcgaccagtgggtcgcaaaagcgaagcagtcgccgaacaccatgtctgacatggctgcgttcgaaaaactggccgcgcctagcgaatacaaccaggtggaatatttctccaacgtgaaaccagacttgtttgccgatgtaattaacaagtttatggctcacggtaagagcatggacatgacccagccagaaggtgagcacagcgcacacgaaggtatggaaggcatggacatgagccacgcggaatccgcccattaa

SEQ ID NO: 161 - DNA, 1992 bp, Escherichia coli
  CDS (1)...(1992)
atgttcggaaaattatcacttgatgcagtcccgttccatgaacctatcgtcatggttacgatcgctggcattattttgggaggtctggcgctcgttggcctgatcacttacttcggtaagtggacctacctgtggaaagagtggctgacctccgtcgaccataaacgcctcggtatcatgtatatcatcgtggcgattgtgatgttgctgcgtggttttgctgacgccattatgatgcgtagccagcaggctcttgcctcggcgggcgaagcgggcttcctgccacctcaccactacgatcagatctttaccgcgcacggcgtgattatgatcttcttcgtggcgatgcctttcgttatcggtctgatgaacctggtggttccgctgcagatcggcgcgcgtgacgttgcgttcccgttcctcaacaacttaagcttctggtttaccgttgttggtgtgattctggttaacgtttctctcggcgtgggcgaatttgcgcagaccggctggctggcctatccaccgctatcgggaatagagtacagtccgggagtcggtgtcgattactggatatggagtctccagctatccggtataggtacgacgcttaccggtatcaacttcttcgttaccattctgaagatgcgcgcaccgggcatgaccatgttcaagatgccagtatttacctgggcatcactgtgcgcgaacgtactgattattgcttccttcccaattctgacggttaccgtcgcgttgttgaccctggatcgctatctgggcacccatttctttaccaacgatatgggtggcaacatgatgatgtacatcaacctgatttgggcctggggccacccggaagtttacatcctgatcctgcctgttttcggtgtgttctccgaaattgcggcaaccttctcgcgtaaacgtctgtttggttatacctcgctggtatgggcaaccgtctgtatcaccgtgctgtcgttcatcgtttggctgcaccacttctttacgatgggtgcgggcgcgaacgtaaacgccttctttggtatcaccacaatgattatcgccatcccgaccggggtgaagatcttcaactggctgttcaccatgtatcagggccgcatcgtgttccattctgcgatgctgtggaccatcggttttatcgtcaccttctcggtgggcgggatgactggcgtgctgctggccgtaccgggcgcggacttcgttctgcataacagcctgttcctgattgcgcacttccataacgtgatcatcggcggcgtggtcttcggctgcttcgcagggatgacctactggtggcctaaagcgttcggtttcaaactgaacgaaacctggggtaaacgcgcgttctggttctggatcatcggcttcttcgttgcctttatgccactgtatgcgctgggcttcatgggcatgacccgtcgtttgagccagcagattgacccgcagttccacaccatgctgatgattgcagccagcggtgcagtactgattgcgctgggtattctctgcctcgttattcagatgtacgtttctattcgcgaccgcgaccagaaccgtgacctgactggcgacccgtggggtggccgtacgctggagtgggcaacctcttccccgcctccgttctataactttgccgtagtgccgcacgttcacgaacgtgatgcattctgggaaatgaaagagaaaggcgaagcgtataaaaagcctgaccactatgaagaaattcatatgccgaaaaacagcggtgcaggtatcgtcattgcagctttctccaccatcttcggtttcgccatgatctggcatatctggtggctggcgattgttggcttcgcaggcatgatcatcacctggatcgtgaaaagcttcgacgaggacgtggattactacgtgccggtggcagaaatcgaaaaactggaaaaccagcatttcgatgagattactaaggcagggctgaaaaatggcaactga

SEQ ID NO: 162 - DNA, 615 bp, Escherichia coli
  CDS (1)...(615)
atggcaactgatactttgacgcacgcgactgcccacgcgcacgaacacgggcaccacgatgcaggcggaaccaaaatcttcggattttggatctacctgatgagcgactgcattctgttctctatcttgtttgctacctatgccgttctggtgaacggcaccgcaggcggcccgacaggtaaggacattttcgaactgccgttcgttctggttgaaactttcttgctgttgttcagctccatcacctacggcatggcggctatcgccatgtacaaaaacaacaaaagccaggttatctcctggctggcgttgacctggttgtttggtgccggatttatcgggatggaaatctatgaattccatcacctgattgttaacggcatgggtccggatcgcagcggcttcctgtcagcgttctttgcgctggtcggcacgcacggtctgcacgtcacttctggtcttatctggatggcggtgctgatggtgcaaatcgcccgtcgcggcctgaccagcactaaccgtacccgcatcatgtgcctgagcctgttctggcacttcctggatgtggtttggatctgtgtgttcactgttgtttatctgatgggggcgatgtaa

SEQ ID NO: 163 - DNA, 330 bp, Escherichia coli
  CDS (1)...(330)
atgagtcattctaccgatcacagcggcgcgtcccatggcagcgtaaaaacctacatgacaggctttatcctgtcgatcattctgacggtgattccgttctggatggtgatgacaggagctgcctctccggccgtaattctgggaacaatcctggcaatggcagtggtacaggttctggtgcatctggtgtgcttcctgcacatgaataccaaatcagatgaaggctggaacatgacggcgtttgtcttcaccgtgctaatcatcgctatcctggttgtaggctccatctggattatgtggaacctcaactacaacatgatgatgcactaa

SEQ ID NO: 164 - DNA, 1764 bp, Escherichia coli
  CDS (1)...(1764)
atgcagtggcaaactaaactcccgctgatcgccattttgcgcggtattacgcccgacgaggcgctggcgcatgttggcgcggtgattgacgccgggttcgacgcggttgaaatcccgctgaattccccacaatgggagcaaagcattcccgccatcgttgatgcgtacggcgacaaggcgttgattggcgcaggtacggtactgaaacctgaacaggtcgatgcgctcgccaggatgggctgtcagctcatcgttacgcccaatatccatagtgaagtgatccgccgtgcggtgggctacggcatgaccgtctgccccggctgcgcgacggcgaccgaagcctttaccgcgctcgaagcgggcgccgcaggcgctgaaaatatttccgtcatcggcttttggtccgcaatacatcaaagcgttaaaagcggtattgccatcggacatcgcagtctttgccgttggcggcgtgacgcagaaaacctggcgcagtggatagacgcaggttgtgcaggggcgggcttaggcagcgatctctatcgcgccgggcaatccgtagagcgcaccgcgcagcaggcagcagcatttgttaaggcgtatcgagaggcaggtgcaatgaaaatcaccaaaattaccacgtatcgtttacctccccgctggatgttcctgaaaattgaaaccgatgaaggcgtggtcggttggggcgagcccgtgatcgaaggccgcgcccgtacggtggaagcggcagttcacgagctgggtgactatttgattggtcaggatccatcgcgcatcaatgacttatggcaagtgatgtatcgcgccggattctatcgcggcggtccgatcctgatgagcgccatcgccgggattgaccaggcgttatgggatatcaaaggtaaagtgctgaatgcgccggtctggcaactgatgggcggcctggttcgcgacaaaattaaagcctacagttgggttggcggcgatcgtccggcggatgttatcgacggcattaaaacgctacgcgaaatcggcttcgataccttcaaactgaacggttgtgaagaactggggctaattgataactcccgcgcggtagatgcggcggttaacaccgtggcacaaattcgtgaagcttttggcaatcagattgagtttggtcttgatttccacggtcgcgtcagcgcgccgatggcgaaagtgctgattaaagaactggagccgtatcgcccgctgtttattgaggagccggtgctggcggaacaagccgaatactacccgaaactggcggcacaaacgcatattccactggcggcgggtgaacgcatgttctcacgcttcgattttaaacgcgtgctggaggcaggtggtatttcgattctgcaaccggatctctcccacgcgggcggtattaccgaatgctacaaaatcgccggaatggcagaagcctatgacgtgacccttgcgccgcactgtccgctcggaccgattgcactggcggcttgcctgcatatcgactttgtttcctataacgccgtacttcaggaacaaagtatgggaattcattacaacaaaggcgcggagttactcgactttgtgaaaaacaaagaagacttcagcatggtcggcggcttctttaaaccgttaacgaaaccgggcttaggcgtggaaatcgacgaagctaaagtgattgagttcagtaaaaatgccccggactggcgtaatccgctctggcgtcatgaagataacagcgtagcagagtggtaa

SEQ ID NO: 165 - DNA, 879 bp, Escherichia coli
  CDS (1)...(879)
atgacagctcgctacatcgcaattgactggggatcgaccaatctgcgcgcctggctttatcagggcgaccactgcctggagagcaggcaatcagaagcaggcgtcacgcgcctgaacggaaaatctccggctgcggtgttagcagaagtcacgaccgactggcgtgaagagaaaacgccagtggtaatggcaggaatggttggcagcaacgtcggctggaaagttgcaccgtatttatctgttcctgcctgtttttcgtctattggcgaacaattaacgtcagttggcgacaatatctggattattcccggattatgtgtctctcatgacgataaccacaatgtgatgcgcggcgaagaaacacaattgatcggcgcgcgagctctggctccttcctctctttatgtcatgcccggaacccattgcaaatgggtgcaggccgatagccagcaaatcaacgattttcgcaccgtgatgaccggtgaattacatcatttactgttaaatcactcattgattggcgcaggtttgccgccgcaggaaaactctgccgatgccttcacagctggccttgagcgtggtcttaatacgcccgccatattgccgcagctttttgaagttcgcgcctcgcatgtgctgggaacacttccccgcgaacaggtcagcgaatttctctctggtttgttgattggcgcagaggtcgccagtatgcgcgactatgtggcccatcaacacgccatcacccttgtcgccggaacatcgctgaccgcgcgctaccagcaagcctttcaggcgatgggttgcgacgtgacggcggtggcgggcgacacggcatttcaggctggtataaggagcatcgctcatgcagtggcaaactaa

SEQ ID NO: 166 - DNA, 387 bp, Escherichia coli
  CDS (1)...(387)
atgactctcaataaaaccgatcgcattgtcattacgctgggtaaacagatcgttcacggcaaatacgtgccaggctcgccgcttccggctgaggcggaactctgtgaggagtttgcaacctcgcgcaacatcatccgtgaggtgttccgttcgctgatggcgaagcggctgattgaaatgaaacgttatcgcggggcgtttgtggcaccgcgtaaccagtggaattacctcgacactgacgtactgcaatgggtgctggaaaatgactacgacccacggcttatcagtgccatgagcgaagtgcgaaatctggtggaaccggcgattgcccgttgggagcagagcgcgcgacttccagcgatctggcgcagattgaatcggcgctga

SEQ ID NO: 167 - DNA, 297 bp, Escherichia coli
  CDS (1)...(297)
atgattgccaacaatcaggaccgcgaagcgtttaacgaagcggatattcgctaccacgaggcggtgctgcagtcggtgcataacccggtgttacagcaacttagcattgcgatcagttcgctgcagcgggcggtttttgaacgaacctggatgggcgatgaggccaacatgccgcaaacgctccaggaacataaggcgctgttcgatgcgatacgacatcaggacggcgatgcggcagagcaggcggcgcttaccatgatcgccagctcgacacgaaggttaaaggaaatcacatga

SEQ ID NO: 168 - DNA, 357 bp, Escherichia coli
  CDS (1)...(357)
atggctcgcgtaaaacgtggtgttattgcacgtgcacgtcacaagaaaattttgaaacaagctaaaggctactacggtgcgcgttctcgcgtataccgcgttgccttccaggctgttatcaaagctggtcagtatgcttaccgtgaccgtcgtcaacgtaagcgtcagttccgtcaactgtggattgcgcgtatcaacgcagcagcacgtcagaacggtatttcttacagcaaattcatcaatggcctgaaaaaagcctctgttgaaatcgaccgtaagatcctggctgatatcgcagtattcgacaaagtagcgttcaccgctctggttgaaaaagcgaaagcagctctggcataa

SEQ ID NO: 169 - DNA, 198 bp, Escherichia coli
  CDS (1)...(198)
atgccaaaaattaagaccgtacgcggtgctgctaagcgcttcaaaaaaaccggtaaaggtggttttaagcacaagcacgctaacctgcgtcacattctgaccaaaaaagcgaccaaacgtaaacgtcacctgcgtccgaaagccatggtttccaaaggcgatctgggcctggtaatcgcgtgcctgccgtacgcataa

SEQ ID NO: 170 - DNA, 543 bp, Escherichia coli
  CDS (1)...(543)
atgaaaggcggaaaacgagttcaaacggcgcgccctaaccgtatcaatggcgaaattcgcgcccaggaagttcgcttaacaggtctggaaggcgagcagcttggtattgtgagtctgagagaagctctggagaaagcagaagaagccggagtagacttagtcgagatcagccctaacgccgagccgccggtttgtcgtataatggattacggcaaattcctctatgaaaagagcaagtcttctaaggaacagaagaaaaagcaaaaagttatccaggttaaggaaattaaattccgtcctggtacagatgaaggcgactatcaggtaaaactccgcagcctgattcgctttctcgaagagggtgataaagccaaaatcacgctgcgtttccgcggtcgtgagatggcgcaccagcaaatcggtatggaagtgcttaatcgcgtgaaagacgatttgcaagaactggcagtggtcgaatccttcccaacgaagatcgaaggccgccagatgatcatggtgctcgctcctaagaagaaacagtaa

SEQ ID NO: 171 - DNA, 1929 bp, Escherichia coli
  CDS (1)...(1929)
atgcctgttataactcttcctgatggcagccaacgccattacgatcacgctgtaagccccatggatgttgcgctggacattggtccaggtctggcgaaagcctgtatcgcagggcgcgttaatggcgaactggttgatgcttgcgatctgattgaaaacgacgcacaactgtcgatcattaccgccaaagacgaagaaggtctggagatcattcgtcactcctgtgcgcacctgttagggcacgcgattaaacaactttggccgcataccaaaatggcaatcggcccggttattgacaacggtttttattacgacgttgatcttgaccgcacgttaacccaggaagatgtcgaagcactcgagaagcggatgcatgagcttgctgagaaaaactacgacgtcattaagaagaaagtcagctggcacgaagcgcgtgaaactttcgccaaccgtggggagagctacaaagtctccattcttgacgaaaacatcgcccatgatgacaagccaggtctgtacttccatgaagaatatgtcgatatgtgccgcggtccgcacgtaccgaacatgcgtttctgccatcatttcaaactaatgaaaacggcaggggcttactggcgtggcgacagcaacaacaaaatgttgcaacgtatttacggtacggcgtgggcagacaaaaaagcacttaacgcttacctgcagcgcctggaagaagccgcgaaacgcgaccaccgtaaaatcggtaaacagctcgacctgtaccatatgcaggaagaagcgccgggtatggtattctggcacaacgacggctggaccatcttccgtgaactggaagtgtttgttcgttctaaactgaaagagtaccagtatcaggaagttaaaggtccgttcatgatggaccgtgtcctgtgggaaaaaaccggtcactgggacaactacaaagatgcaatgttcaccacatcttctgagaaccgtgaatactgcattaagccgatgaactgcccgggtcacgtacaaattttcaaccaggggctgaagtcttatcgcgatctgccgctgcgtatggccgagtttggtagctgccaccgtaacgagccgtcaggttcgctgcatggcctgatgcgcgtgcgtggatttacccaggatgacgcgcatatcttctgtactgaagaacaaattcgcgatgaagttaacggatgtatccgtttagtctatgatatgtacagcacttttggcttcgagaagatcgtcgtcaaactctccactcgtcctgaaaaacgtattggcagcgacgaaatgtgggatcgtgctgaggcggacctggcggttgcgctggaagaaaacaacatcccgtttgaatatcaactgggtgaaggcgctttctacggtccgaaaattgaatttaccctgtatgactgcctcgatcgtgcatggcagtgcggtacagtacagctggacttctctttgccgtctcgtctgagcgcttcttatgtaggcgaagacaatgaacgtaaagtaccggtaatgattcaccgcgcaattctggggtcgatggaacgtttcatcggtatcctgaccgaagagttcgctggtttcttcccgacctggcttgcgccggttcaggttgttatcatgaatattaccgattcacagtctgaatacgttaacgaattgacgcaaaaactatcaaatgcgggcattcgtgttaaagcagacttgagaaatgagaagattggctttaaaatccgcgagcacactttgcgtcgcgtcccatatatgctggtctgtggtgataaagaggtggaatcaggcaaagttgccgttcgcacccgccgtggtaaagacctgggaagcatggacgtaaatgaagtgatcgagaagctgcaacaagagattcgcagccgcagtcttaaacaattggaggaataa

SEQ ID NO: 172 - DNA, 993 bp, Escherichia coli
  CDS (1)...(993)
atgaaaataaagaacattctactcaccctttgcacctcactcctgcttaccaacgttgctgcacacgccaaagaagtcaaaataggtatggcgattgatgatctccgtcttgaacgctggcaaaaagatcgagatatctttgtgaaaaaggcagaatctctcggcgcgaaagtatttgtacagtctgcaaatggcaatgaagaaacacaaatgtcgcagattgaaaacatgataaaccggggtgtcgatgttcttgtcattattccgtataacggtcaggtattaagtaacgttgtaaaagaagccaaacaagaaggcattaaagtattagcttacgaccgtatgattaacgatgcggatatcgatttttatatttctttcgataacgaaaaagtcggtgaactgcaggcaaaagccctggtcgatattgttccgcaaggtaattacttcctgatgggcggctcgccggtagataacaacgccaagctgttccgcgccggacaaatgaaagtgttaaaaccttacgttgattccggaaaaattaaagtcgttggtgaccaatgggttgatggctggttaccggaaaacgcattgaaaattatggaaaacgcgctaaccgccaataataacaaaattgatgctgtagttgcctcaaacgatgccaccgcaggtggggcaattcaggcattaagcgcgcaaggtttatcagggaaagtagcaatctccggccaggatgcggatctcgcaggtattaaacgtattgctgccggtacgcaaactatgacggtgtataaacctattacgttgttggcaaatactgccgcagaaattgccgttgagttgggcaatggtcaggaaccaaaagcagataccacactgaataatggcctgaaagatgtcccctcccgcctcctgacaccgatcgatgtgaataaaaacaacatcaaagatacggtaattaaagacggattccacaaagagagcgagctgtaa

SEQ ID NO: 173 - DNA, 168 bp, Escherichia coli
  CDS (1)...(168)
atgaacaaatttattaaagttgcactggtaggtgcagtactggctacgttaactgcatgtactggtcatattgaaaaccgtgataagaactgctcttacgactacctgctgcacccggcaatttctatttctaaaatcattggcggttgcggtcctactgcacagtaa

SEQ ID NO: 174 - DNA, 1389 bp, Escherichia coli
  CDS (1)...(1389)
atgactgcaaactctcccctacaacgtattggacaagaaaaaggtatcgctatgggaagccaggaactccaacgcaagctcggattttgggccgttcttgcaatcgccgtcgggacaaccgtcggctccggtatttttgtatctgtgggtgaagtggcaaaagcagcgggcacgccgtggcttacggtgctcgcgtttgtcattggcgggttaattgtgatcccgcaaatgtgcgtctatgcggaactatccaccgcttatccggaaaatggcgcagattatgtttatctgaaaaatgccggaagccgaccgctggctttcctctccggctgggccagcttctgggccaacgatgcgccgtcattgtcgattatggcgctggcgattgtcagcaatcttggctttttaacgcctatcgatccgttgctcggtaaatttatcgccgccggattaattatcgcctttatgttgctacacctgcgctccgttgaaggcggcgcagcgtttcagacgctaattaccatcgccaaaattatcccgttcactatcgtcattggccttgggatcttctggtttaaagcggagaattttgccgcccctaccaccactgcgattggcgcaacgggcagctttatggcgctgctggcggggatctctgccaccagttggtcgtataccggcatggcctctatctgttatatgaccggcgaaattaaaaaccccggaaaaaccatgccacgagcgctgattggttcctgtctgctggttctggtgctctacaccctgctggcgctggtgatttccggcctgatgcccttcgacaaactcgccaattctgaaacgccgatttccgacgccctgacctggatccccgcactcggcagcaccgctgggatctttgttgccatcacggcgatgatcgtcattcttggttcgctttccagctgcgtgatgtaccagccgcggctggaatacgcgatggcgaaagacaacctgttctttaaatgcttcggccatgtgcatccgaaatacaacacgccggatgtctccatcatcctgcaaggggcgctggggatcttcttcatcttcgtttccgatctcaccagcctgctgggttatttcaccctggtgatgtgtttcaaaaataccctcaccttcggctccatcatctggtgtcgtaaacgcgacgattacaaaccgctgtggcgtactccggctttcgggctgatgaccaccctcgccattgcgtcaagcctcattctggtcgcctcaacctttgtctgggcaccgattcccggccttatctgcgccgtcatcgttattgctactggtctgcctgcttacgccttctgggcgaagcgtagccgccagctcaacgctttgtcgtaa

SEQ ID NO: 175 - DNA, 1044 bp, Escherichia coli
  CDS (1)...(1044)
atgttatctggagaaaataaaatgttggatattgataaaagcaccgtggactttctggtcaccgaaaatatggttcaggaagtggaaaaagttctcagccatgacgttccgctggtgcacgccatcgtggaagagatggtgaagcgcgacattgatcgtatttatttcgttgcctgcggatcgccactcaacgcggcgcaaacggcgaaacatctggcggatcgcttttccgatcttcaggtctacgccatttccggctgggagttctgcgataacaccccgtatcgcctcgacgatcgttgcgcagtaattggcgtttctgactacggtaaaaccgaagaggtaatcaaagcgctggagctgggccgggcctgcggcgcactcactgcggcgttcaccaaacgcgcggatagcccgattacctcggcggcggaatttagcattgattatcaggccgactgtatctgggaaattcacctgctgctctgctacagcgtggtgctggagatgatcacccgcctcgcgccgaacgcggaaatcggcaagatcaaaaacgatctcaagcagttgccgaatgcgctcggtcatctggtacgcacctgggaagaaaaaggccgccagcttggtgaactggccagccagtggccgatgatttataccgttgctgcgggtccgctgcgtccgctgggttacaaagaaggcattgtaacgctgatggaatttacctggacgcacggctgcgtgattgagagcggagagttccgccatggcccgctggagattgtcgaaccgggcgttccgttcctgttcctgctcggcaatgatgaaagtcgccacaccaccgaacgcgccattaactttgttaaacagcgtactgacaacgtgatcgtcatcgattacgccgaaatttcgcaagggctgcacccgtggctggcaccgttcctgatgttcgtgccaatggagtggctctgctactacctgtctatttacaaagatcacaacccggatgaacgccgctattacggtggtctggtggaatattaa

SEQ ID NO: 176 - DNA, 450 bp, Escherichia coli
  CDS (1)...(450)
atgaacgccgctattacggtggtctggtggaatattaatccctctcccggcccggcaacgggccggatttacgcaaggagttacccgatgaaaacaggtatgtttacctgcggccaccagcggctgcctattgaacacgcatttcgtgatgcaagcgagctgggttacgacggcatcgaaatttggggcggtcgcccgcacgcgttcgcgccggacttaaaagcgggcggcatcaaacaaatcaaggcgctggcgcagacgtatcagatgccgattatcggctatacgccagaaaccaacggctatccgtataacatgatgctgggcgatgaacatatgcgtcgcgaaagcctcgacatgatcaagctggcgatggatatggcaaaagagatgaacgcgggttatacgctgatttccgccggcccacgcgggctatctcacgccacctaa

SEQ ID NO: 177 - DNA, 384 bp, Escherichia coli
  CDS (1)...(384)
atgcgtgatattcagatggttcttgagcgttggggagcgtgggcggctaataatcatgaagatgtgacctggtcgtccattgccgccggttttaagggattaattacttcaaaagtaaaatctcgcccgcaatgttgtgacgatgacgcgatgatcatttgcgggtgcatggcccgtctgaaaaagaacaacagcgatttgcacgatttattagtagattattatgtagtcggtatgacattcatgtcactggcaggtaagcattgctgctctgatggttatatcgggaaaaggttacagaaggctgagggcataattgaagggatgttaatggcattagatatccggttagagatggatatcgttgttaataactctaattaa

SEQ ID NO: 178 - DNA, 1362 bp, Escherichia coli
  CDS (1)...(1362)
atgtttgataatttaaccgatcgtttgtcgcgcacgctgcgcaatatcagtggccgtggacgcctcactgaagacaacgtaaaagatacgctgcgcgaagtgcgcatggcgctgctggaggcggacgtagctctgccggtagtgcgtgagtttatcaatcgcgtaaaagagaaagcggttggtcatgaagttaataagagcctgacgccggggcaggagttcgtcaaaatagtccgtaacgaactggttgcggcgatgggcgaagagaaccagaccctgaacctggctgcgcaaccgcctgcggtcgtactgatggcgggcctgcaaggtgccggtaaaacaaccagcgttggtaaactcggtaagttcctgcgcgagaagcacaagaagaaagtgctggtggtttctgccgacgtttatcgcccggcggcaatcaaacagcttgagacgctggcagagcaggtgggcgttgatttcttcccttctgatgttggtcagaagccggtagatatcgttaacgcggcgctgaaagaagccaaactgaaattctacgacgtgctgctggtggataccgctggtcgtctgcacgttgacgaagcgatgatggacgagatcaaacaagtccatgcgtcgattaacccggttgaaaccctgtttgtggttgacgccatgaccggtcaggatgcggccaatacggcaaaagcattcaatgaagcgttaccgcttaccggcgtagtgttgaccaaagtggacggcgatgcccgcggcggtgcggcgctctctattcgtcacatcactggcaaaccgatcaagttcctcggtgttggcgagaaaactgaggcgctggagccgttccatccggaccgcatcgcgtcgcgtattctcggcatgggcgacgtactgtcgctgatcgaagatatcgaaagcaaagttgaccgcgcgcaggcagagaaattagccagcaagctgaaaaaaggtgacggcttcgatctcaacgactttcttgagcagctgcgccagatgaaaaatatgggcggcatggctagtctgatgggcaagctgccgggcatggggcagatcccggataacgtcaagtcacagatggacgataaagtgctggtgcgtatggaagccatcatcaactcgatgacgatgaaagagcgcgctaagccagaaatcatcaaaggttcgcgtaaacgccgtattgctgccggttgcggtatgcaggtgcaggacgttaaccgtcttctgaaacagttcgacgacatgcagcgcatgatgaagaaaatgaagaagggcggaatggcgaagatgatgagaagcatgaagggtatgatgcccccaggcttccctggtcgctaa

SEQ ID NO: 179 - DNA, 1734 bp, Escherichia coli
  CDS (1)...(1734)
gtgaaacaacagatacaacttcgtcgccgtgaagtcgatgaaacggcagacttgcccgctgaattgcctcccttgctgcgccgtttatacgccagccggggagtacgcagtgcgcaagaactggaacgcagtgttaaaggtatgctgccctggcagcaactgagcggcgtcgaaaaggccgttgagatcctttacaacgcttttcgcgaaggaacgcggattattgtggtcggtgatttcgacgccgacggcgcgaccagcacggctctaagcgtgctggcgatgcgctcgcttggttgcagcaatatcgactacctggtaccaaaccgtttcgaagacggttacggcttaagcccggaagtggtcgatcaggcccatgcccgtggcgcgcagttaattgtcacggtggataacggtatttcctcccatgcgggggttgagcacgctcgctcgttgggcatcccggttattgttaccgatcaccatttgccaggcgacacattacccgcagcggaagcgatcattaaccctaacttgcgcgactgtaatttcccgtcgaaatcactggcaggcgtgggtgtggcgttttatctgatgctggcgctgcgcacctttttgcgcgatcagggctggtttgatgagcgtaacatcgcaattcctaacctggcagaactgctggatctggtcgcgctggggacagtggcggacgtcgtgccgctggacgctaataatcgcattctgacctggcaggggatgagtcgcatccgagccggaaagtgccgtccggggattaaagcgctgcttgaagtggcaaaccgtgatgcacaaaaactcgccgccagcgatttaggttttgcgctggggccacgtctcaatgctgccggacgactggacgatatgtccgtcggtgtggcgctgttgttgtgcgacaacatcggcgaagcgcgcgtgctggcaaatgaactcgatgcgctaaaccagacgcgaaaagagatcgaacaaggaatgcaaattgaagccctgaccctgtgcgagaaactggagcgcagccgtgacacgctacccggcgggctggcaatgtatcaccccgaatggcatcagggcgttgtcggtattctggcttcgcgcatcaaagagcgttttcaccgtccggttatcgcgtttgcgccagcaggtgacggtacgctgaaaggttccggtcgctccattcaggggctgcatatgcgtgatgcgctggagcgattagacacactctaccctggcatgatgctgaagtttggcggtcatgcgatggcggcgggtttgtcgctggaagaggataaattcaaactctttcaacaacggtttggcgaactggttactgagtggctggacccttcgctattgcaaggcgaagtggtatcagacggtccgttaagcccggccgaaatgaccatggaagtggcgcagctgctgcgcgatgctggcccgtgggggcagatgttcccggagccgctgtttgacggtcatttccgtctgctgcaacagcggctggtgggcgaacgtcatttgaaggtgatggtcgaaccggtcggcggcggtccactgctggatggtattgcttttaatgtcgataccgccctctggccggataacggcgtgcgcgaagtgcaactggcttataagctcgatatcaacgagtttcgcggcaaccgcagcctgcaaattatcatcgacaatatctggccaatttag

SEQ ID NO: 180 - DNA, 711 bp, Escherichia coli
  CDS (1)...(711)
atgaagaaaggttttatgttgtttactttgttagcggcgttttcaggctttgctcaggctgatgacgcggcaattcaacaaacgttagccaaaatgggcatcaaaagcagcgatattcagcccgcgcctgtagctggcatgaagacagttctgactaacagcggcgtgttgtacatcaccgatgatggtaaacatatcattcaggggccaatgtatgacgttagtggcacggctccggtcaatgtcaccaataagatgctgttaaagcagttgaatgcgcttgaaaaagagatgatcgtttataaagcgccgcaggaaaaacacgtcatcaccgtgtttactgatattacctgtggttactgccacaaactgcatgagcaaatggcagactacaacgcgctggggatcaccgtgcgttatcttgctttcccgcgccaggggctggacagcgatgcagagaaagaaatgaaagctatctggtgtgcgaaagataaaaacaaagcgtttgatgatgtgatggcaggtaaaagcgtcgcaccagccagttgcgacgtggatattgccgaccattacgcacttggcgtccagcttggcgttagcggtactccggcagttgtgctgagcaatggcacacttgttccgggttaccagccgccgaaagagatgaaagaattcctcgacgaacaccaaaaaatgaccagcggtaaataa

SEQ ID NO: 181 - DNA, 897 bp, Escherichia coli
  CDS (1)...(897)
gtgaaacaggatctggcacgcatcgagcagtttcttgatgctctgtggctggaaaaaaatctggctgaaaatacgttgaacgcttaccgtcgcgatctgtcaatgatggtggagtggttgcatcaccgcgggttgacgctggcgacggcgcaaagtgacgatttgcaggcattactggcagaacggctggagggcgggtataaagccaccagctcagcgcgtttgctgagtgcagtgcgccgattgttccagtatctttatcgcgaaaagtttcgtgaagacgatcccagtgcgcatctcgcttcaccgaaattgccccagcgtttgccaaaagatttaagcgaagcgcaggtcgaacgtttattacaggcaccattaatcgatcagccactggagctacgcgataaagccatgcttgaagtgttgtatgctaccgggctgcgtgtctctgaactggtcggactgacaatgagtgatatcagcctgcgtcagggcgtggtacgggtcattggtaaaggcaacaaagagcgtctggtgccgttaggtgaagaggcggtttactggctggaaacctatctggaacatgggcgtccgtggctgctgaatggtgtgtcaattgacgtgttgtttcccagccagcgtgcgcagcagatgacgcgacagaccttctggcaccgtattaaacattatgctgtgctggcgggtatcgacagcgaaaagctgtcaccgcatgtgttgcgtcacgcttttgccactcatttattaaatcatggtgcggatttacgcgtggtgcagatgctactgggccacagcgatctctccaccacgcaaatttatacgcatgtcgctaccgagcgtctgcggcaacttcatcaacagcatcacccgcgggcgtga

SEQ ID NO: 182 - DNA, 741 bp, Escherichia coli
  CDS (1)...(741)
atgttttttaacaccaaacatacaacagctttatgcttcgtaacctgtatggcttttagttcatcgtctattgcggacattgtcatttcgggtactcgcgtaatatataaaagcgatcaaaaaagtgtcaacgtacgtctggaaaataaagggaataacccgttgcttgtccagagttggttagatactggcgatgacaacgctgagcctggcagtattacagtcccttttactgctacgccgccagtatcgcgtattgatgccaaacgtgggcaaacaatcaaattaatgtacacagccagcacctcactgcctaaagacagagagagcgtgttctggtttaacgtactggaagttccaccaaaaccagatgcagaaaaggtcgcgaatcaaagcctgctgcaactggcatttcgcacacgtataaaacttttctatcgcccggatggattgaagggaaatccctctgaagccccgttagccctgaagtggttctggtcaggttcagaaggtaaggcgtcattacgagtgaccaatccaaccccttactacgtctcttttagcagtggtgatttagaagctagcggtaaacgctatccgattgatgtgaaaatgattgcaccatttagtgatgaggtcatgaaagtcaatggccttaatggcaaagcgaattctgcaaaagtgcatttttacgccattaatgactttggtggcgcaattgaaggtaatgccaggctgtaa

SEQ ID NO: 183 - DNA, 2598 bp, Escherichia coli
  CDS (1)...(2598)
gtgactatagaatatactaaaaattatcatcatctgacccgtatcgccacgttttgcgcgctgctgtattgcaatactgctttcagtgctgaactcgttgaatatgaccataccttcctgatggggcagaatgcatctaatattgatctcagccggtacagtgaaggtaaccccgctataccgggtgtttacgacgtcagtgtttatgtaaacgaccaaccaatcattaaccaaagtattacatttgtcgcaattgaaggaaaaaagaacgcccaggcttgtatcacattaaagaatttattgcagtttcatattaattctcccgatataaataacgaaaaagccgttctgcttgccagggatgaaacgctcggcaattgcctcaatttgacggaaattatccctcaggcttctgttcgttatgacgttaacgatcaacgtctggatatagacgttcctcaagcctgggtaatgaaaaattaccaaaactatgttgatccatcgttatgggaaaacggcattaatgcggccatgttgtcatacaacctcaacggatatcatagtgaaacccctggtcgaaaaaatgaaagcatttatgctgcatttaacggtgggatgaatttaggtgcatggcgactgcgtgcctcgggcaactacaactggatgaccgattctggcagtaattatgattttaagaatcggtatgttcagcgtgatatcgcctcgctgcgttctcaactcattcttggtgagtcttatacgacgggcgaaacctttgattccgtcagtatccgaggcattcgtttatacagtgacagccgcatgttgcctccgactttagccagctttgcgcctatcattcatggcgttgccaataccaacgccaaagtcactattacgcaaggtggctataagatttatgaaacgacggtgccgccaggcgctttcgtcattgatgatctgagtccgtcagggtacggcagcgatcttattgttaccatcgaagaatccgatggctcaaagcggacattctcgcaacctttctcatccgttgttcaaatgttacgccctggcgttggacgttgggatattagcggcggtcaggtcttaaaagatgatattcaggatgagcctaatttatttcaagcaagctactactacggcctgaataactatctgacgggttataccggtattcagataaccgataataactataccgctggtttgttaggtcttggtctgaatacttcagttggtgcattttctttcgatgtgactcattccaatgttcgtatcccggatgataaaacataccaggggcaaagttatcgtgtttcctggaacaagttattcgaagaaacaagtacttcactgaatatcgcggcctatcgctattcgacacagaattaccttggtcttaatgatgcactaactctaattgatgaagtgaaacatcccgaacaagatcttgaaccgaaatccatgcgtaattactcacgcatgaaaaatcaggttacggtcagtattaaccaaccgttgaaatttgagaaaaaagattacggttcattttatctttccggaagttggtccgattactgggcttccggacaaaatcgtagcaattactctattggctacagtaacagtacatcctggggcagctacagtgtcagtgcccagcgttcatggaatgaagacggcgacactgacgatagcgtttatcttagtttcaccattccaattgaaaaattacttggcactgaacaacgtacttcaggtttccagagtattgatactcaaataagcagtgactttaagggtaataaccaactcaacgttagcagcagtggctatagcgataacgctcgcgtcagttatagcgtgaatactggctatacgatgaataaagccagcaaagatttgagttatgttgggggttatgccagctatgagtcaccatggggaacgctggcaggttcaatttctgcaaatagcgataacagccgtcaagtttctctcagcaccgacggtggttttgtattgcatagcggtggactgactttcagtaatgatagttttagcgactccgatacactggcggtagttcaggctccaggtgctcaaggagcgcgaataaattatggcaacagtactatcgatcgatggggttatggtgtcaccagcgctctttctccttatcatgaaaaccgtatcgcgctggatatcaacgatcttgagaacgatgttgaattaaaaagtaccagtgcagtagctgtaccgcgtcagggttcagtcgtctttgctgattttgaaaccgtgcaagggcaatcagccattatgaacatcacacgaagtgatggtaaaaatattccatttgctgcagatatttatgatgagcaaggcaatgtcattggtaatgttggacagggtggacaagcatttgttcgtggtattgagcagcagggaaatatcagcattaaatggctcgaacaaagtaaacccgtaagttgtcttgcgcattatcaacaaagcccagaagcagaaaaaatagcacaatctattattctgaatggaattcggtgtcagattcagtaa

SEQ ID NO: 184 - DNA, 1986 bp, Escherichia coli
  CDS (1)...(1986)
atgaaaaccgttagggagtccacaacgttgtacaactttctcggatcgcacaatccatactggcggttgacggaaagcagcgatgttttgcgcttttctaccaccgaaaccacagaacctgatcgtacattgcagttatctgccgaacaggctgctcgcatcagggaaatgacggtcatcacctccagcctgatgatgagtctgaccgtcgatgaaagcgatctttctgtgcatctggtaggacgaaaaatcaataaacgggaatgggctggcaacgcgtctgcatggcatgacacaccggcggttgctcgtgatttatcacacgggctttcctttgctgagcaggtagtttctgaagcacattccgcaatagtgattctcgacagccgggggaatatccaacgcttcaatcggttatgtgaagattacacagggttgaaagaacacgacgtcattgggcaaagcgtgtttaaactgtttatgagccgtcgtgaagctgcggcatccaggcgcaataaccgtgtattttttcgaagcggcaatgcatatgaagtcgaactgtggataccaacatgtaaaggccagcggctgtttctgtttcgcaataaatttgtccacagcggcagtggcaaaaacgagatttttttaatctgttccggcaccgacattaccgaagagcgccgcgctcaggagcgactgcgtattctggcaaataccgacagtatcaccggactgccgaatcgtaacgcaatgcaggatttaatcgatcacgctattaatcatgcagataacaataaagttggggttgtgtatcttgatttggataatttcaaaaaggtcaacgacgcctatgggcatttgtttggtgaccagttattacgcgacgtgtcattggctattttaagctgtctcgaacatgaccaggtgttggcgcgtccaggtggggatgagtttctggtactggcatccaacacctcacaaagcgcgctggaagcaatggcatcacgaattttgacccgcttacggctcccctttcgcattggtttaattgaagtttataccagctgttcagtaggtattgcactctctcccgaacatggttcagacagcacggctattattcgtcacgccgacacagcaatgtacacagcgaaggaaggcggacgaggacaattttgcgtttttaccccagaaatgaatcaacgggtatttgaatatctctggctggataccaacttgcgtaaagcactggaaaacgatcagttggttattcactatcaaccgaaaatcacctggcgtggcgaagtgcgcagtctggaagcactagtacgttggcagtcacctgaacgtgggttgattccaccgttggacttcatttcctacgccgaagagtcagggctaattgtgcctttaggccgttgggtgattctcgatgtcgtacgccaggtggcaaagtggcgggataaaggcataaacctgcgagtggcggtaaatatttctgcacgtcagctcgccgatcaaaccattttcaccgccctgaaacaggttctccaggaactcaattttgaatactgccctatagatgttgaactgacagagagttgtctgattgagaatgatgaactggcactgtctgttattcaacaatttagccaactaggtgcgcaagtgcatctggatgattttggtaccggctactcttcactttcgcaactggcgcgctttccgatcgatgccatcaaacttgaccaggtttttgttcgagatattcacaaacaacctgtctcgcagtcactggtccgggcgatcgtcgctgtggcccaggcattgaatcttcaggtgatcgccgaaggtgtagagagtgcaaaggaagatgcttttttaaccaagaacgggatcaatgagcggcaaggatttttgtttgccaaaccgatgcccgccgtcgccttcgaacgctggtataaacgctatctgaagcgcgcataa

SEQ ID NO: 185 - DNA, 693 bp, Escherichia coli
  CDS (1)...(693)
atgatgactaaaataaagttattgatgctcattatattttatttaatcatttcggccagcgcccatgctgccggagggatcgcattaggtgccacgcgtattatttatcccgctgatgctaaacagactgcggtatggattagaaatagccataccaatgagcgctttctggtcaattcgtggattgaaaacagcagcggtgtaaaagaaaagtcattcatcattacaccgccactgtttgttagtgaacccaaaagcgaaaatactttgcgtattatttacaccggtccaccgctggcagcagatcgtgagtctctgttctggatgaatgttaagacgatcccttcggtagataaaaatgcattgaacggcaggaatgttttgcaactggcgattttatcgcgcatgaaattatttctccgtccaattcaattacaagaattacccgcagaagcgccggacacactcaagttttcgcgatccggtaactatatcaatgttcataatccatcacctttttatgtcaccctggttaacttacaagtgggcagccaaaagttggggaatgctatggctgcacccagagttaattcacaaattcccttaccctcaggagtgcagggaaagctgaaatttcagaccgttaatgattatggttcagtaactccggtcagagaagtgaacttaaactaa

SEQ ID NO: 186 - DNA, 2604 bp, Escherichia coli
  CDS (1)...(2604)
atgaaaatacccactactacggatattccgcagaggtatacctggtgtctggccggaatttgttattcatctcttgccattttaccctcctttttaagctatgcggaaagttatttcaacccggcatttttattagagaatggcacatccgttgctgatttatcgcgctttgagagaggtaatcatcaacctgcgggcgtgtatcgggtggatctctggcgtaatgatgagttcattggttcgcaggatatcgtatttgaatcgacaacagaaaatacaggtgataaatcaggtgggttaatgccctgttttaaccaggtacttcttgaacgaattggccttaatagcagtgcatttcccgagttagcccagcagcaaaacaataaatgcatcaatttactgaaagctgtacctgatgccacaattaactttgattttgcagcgatgcgcctgaacatcactattcctcagatagcgttgttgagtagcgctcacggttacattccgcctgaagagtgggatgaaggtattcctgctttactcctgaattataatttcaccggtaacagaggtaatggtaacgatagctatttttttagtgagctcagcgggattaatattggcccgtggcgtttacgcaacaatggttcctggaactattttcgcggaaatggatatcattcagaacagtggaataatattggcacctgggtacagcgcgccattattccgctgaaaagtgaactggtaatgggagacggcaatacaggaagtgatattttcgatggcgttggatttcgtggtgtacggctttattcttctgataatatgtatcctgatagccagcaagggtttgccccaacggtacgtgggattgcccgtacggcggcccagctaacgattcggcaaaatggttttattatctatcaaagctatgtttcccccggcgcttttgaaattacagatttgcacccgacatcttcaaatggcgatctggacgtcaccatcgacgagcgcgatggcaatcagcagaattacacaattccgtattcaacagtgccaattttacaacgcgaagggcgtttcaaatttgacctgacggcgggcgattttcgtagcggtaatagtcagcaatcatcgcctttcttttttcagggtacggcactcggcggtttaccacaggaatttactgcctacggcgggacgcaattatctgccaattacaccgcctttttattagggctggggcgcaatctcgggaactggggcgcagtgtcgctggatgtaacgcatgcgcgcagtcagttagccgacgccagtcgtcatgagggggattctattcgcttcctctatgcgaaatcgatgaacaccttcggcaccaattttcagttaatgggttaccgctattcgacacaaggtttttatacccttgatgatgttgcgtatcgtcgaatggaggggtacgaatatgattacgacggtgagcatcgcgatgaaccgataatcgtgaattaccacaatttacgctttagccgtaaagaccgtttgcagttaaatgtttcacaatcacttaatgactttggctcgctttatatttctggtacccatcaaaaatactggaatacttcggattcagatacgtggtatcaggtggggtataccagcagctgggttggcatcagttattcgctctcattttcgtggaatgaatctgtagggatccccgataacgaacgtattgtcggacttaatgtttcagtgcctttcaatgttttgaccaaacgtcgctacacccgggaaaatgcgctcgaccgcgcttatgcctcctttaacgccaaccgtaacagcaacgggcaaaatagctggctggcaggtgtaggtgggaccttactggaaggccacaacctgagttatcacgtaagccagggtgatacctcgaataatgggtacacgggcagcgccacggcaaactggcaggccgcttacggtacgctggggggcgggtataactacgaccgcgatcaacatgacgttaactggcagctgtctggcggtgtggtcgggcatgaaaatggcataacgctgagccagcctttaggggataccaatgttttgattaaagcgcctggcgcaggcggtgtacgcattgaaaatcaaactggcattttaaccgactggcgcggctatgcggtgatgctgtatgccacggtttatcggtataaccgtatcgcgcttgataccaatacgatggggaattccatcgatgttgaaaaaaatattagcagcgttgtgccgacgcaaggcgcgttggttcgtgccaattttgatacccgcataggcgtgcgggcgctcattaccgttacccagggcggaaaaccggtgccgtttggatcactggtacgggaaaacagtaccggaataaccagtatggtgggtgatgacgggcaagtttatttaagtggtgcgccattgtctggtgaattactggttcagtggggagacggcgcgaactcacgctgcattgcgcactatgtattgccgaagcaaagcttacagcaagccgtcactgttatttcggcagtttgcacacatcctggctcataa

SEQ ID NO: 187 - DNA, 978 bp, Escherichia coli
  CDS (1)...(978)
atggcatgtttgtgtctggcaaacatatcctgggctactgtttgtgcaaatagtactggcgtagcagaagatgaacactatgatctctcaaatatctttaatagcaccaataaccagccagggcagattgttgttttaccggaaaaatccggctgggtaggtgtctcagcaatttgtccacccggtacgctggtgaattatacataccgtagttatgtcaccaactttattgttcaggaaactatcgataattataaatatatgcaattacatgattatctattaggtgcgatgagtctggttgatagtgtgatggatattcagttccccccgcaaaattatattcggatgggaacagatcctaacgtttcgcaaaaccttccattcggggtgatggattctcgtttaatatttcgtttaaaggttattcgtccctttattaacatggtggagatccccagacaggtgatgtttaccgtgtatgtgacatcaacgccttacgatccgttggttacacctgtttataccattagttttggtggccgggttgaagtaccgcaaaactgcgaattaaatgccgggcagattgttgaatttgattttggtgatatcggcgcatcgttatttagtgcggcagggccgggtaatcgacctgctggtgtcatgccgcaaaccaagagcattgcggtcaaatgtacgaatgttgctgcgcaggcttatttaacaatgcgtctggaagccagtgccgtttctggtcaggcgatggtgtcggacaatcaggatttaggttttattgtcgccgatcagaacgatacgccgatcacgcctaacgatctcaatagcgttattcctttccgtctggatgcagctgcggcagccaatgtcacacttcgcgcctggcctatcagtattaccggtcaaaaaccgaccgaagggccgtttagcgcgctggggtatttacgcgtcgattatcaatga

SEQ ID NO: 188 - DNA, 516 bp, Escherichia coli
  CDS (1)...(516)
atgagaagagtactctttagctgtttctgcgggctactgtggagttccagtggatgggcagttgaccctttaggaacgattaatatcaatttgcacggtaacgttgttgatttctcctgtaccgtaaacacagcggatattgataagacggtagatttaggcagatggcctacgacacaactactgaacgctggcgataccacggcactcgtcccttttagcctgcggctggagggatgtcctccgggttcagttgcgattttatttacgggaacgccggcatccgataccaacctgctggctctggatgatcccgcaatggcacaaaccgtcgccatcgaattacgtaatagcgatcgctcccggctcgcactgggggaggcgagcccgactgaggaagtagatgcaaatggcaatgtcacactaaacttttttgccaattatcgagcgttagccagcggtgttcggccaggtgtggcgaaagcggatgcgatatttatgatcaattataattaa

SEQ ID NO: 189 - DNA, 585 bp, Escherichia coli
  CDS (1)...(585)
atgtttggctatcgcagtaacgtgccaaaagtgcgcttaaccacagaccgactggtcgtgcgtctggtgcatgatcgtgatgcctggcgtcttgcggattattacgcagagaatcgccatttcctcaagccctgggagccagtgcgcgacgaaagccactgttatccatcaggctggcaggccaggctggggatgattaacgaatttcataaacaaggttcagctttctactttggcttattcgacccggacgaaaaagagattattggcgttgccaatttttccaatgttgttcgtggctcttttcatgcctgctatctcggttattcgattgggcaaaaatggcagggcaaaggactcatgtttgaagccctgaccgcagccattcgttatatgcagcgcacccaacatattcatcgcattatggctaattatatgccgcacaataaacgcagcggtgatttactggcgcgactgggttttgaaaaagaaggctatgcgaaagactatctgttgattgatggacaatggcgcgatcacgtactgacggcattaactaccccagactggacgcccggccgctaa

SEQ ID NO: 190 - DNA, 648 bp, Escherichia coli
  CDS (1)...(648)
atgaaatatcaacttactgcccttgaagctcgcgtgattggttgcttgctggaaaagcaggtgaccacgccggagcaatacccgctctcagtcaatggtgtagtcacggcctgtaatcagaaaacgaaccgtgaaccggtcatgaatctgagtgaatccgaagtgcaggaacagctggataatctggtcaaacgtcattatctacgcacagtgagcggttttggtaatcgggtcaccaaatatgagcaacgtttttgtaattcagaatttggcgatctgaaactgagcgcagcggaagtggcgttaatcaccacgttgttattgcgtggtgcccagacgccaggtgaactgcgcagccgcgccgcgcgaatgtatgaattcagcgatatggcggaagtggagtcgacgctggaacaactggcaaatcgcgaagatggtccttttgtggtgcgtctggcccgcgaaccgggtaaacgcgaaaaccgctacatgcatcttttcagtggtgaggttgaagatcagccggcggtgacggatatgtcgaacgcggttgacggtgatttacaggcccgcgtcgaagccctggaaatcgaagtggcagaactgaaacagcgtcttgattcgttgctggcccatctgggagattaa

SEQ ID NO: 191 - DNA, 924 bp, Escherichia coli
  CDS (1)...(924)
gtgaaaaaattacgtatcggcgtagtgggattaggtggcattgcgcaaaaagcgtggttaccggtgctggcggcagcgtctgactggacgttacaaggagcctggtcgcctacgcgcgcgaaagccctgccaatttgtgaaagctggcgcattccttatgccgattcgttatccagccttgccgccagttgcgatgcggtttttgtgcattccagcaccgccagccactttgacgtggtcagtacgttactcaatgcgggggtacatgtctgtgtcgataaaccgctggcagaaaatctgcgcgatgctgaacggctggtggaactggcggcgcggaaaaaactgacgttgatggtcggttttaaccgtcgtttcgcaccactctacggtgagttaaaaacgcaactcgccaccgcagcctcgctaagaatggataaacatcgtagcaatagcgtcgggccacacgatctttatttcacgttgctggatgattatctgcatgtggtggataccgcgctgtggttgtcgggcggcaaagcctctctggatggcggtacgctactgactaacgacgctggcgaaatgctgtttgccgagcaccatttttcggctggtcctttgcagatcaccacctgtatgcatcgccgtgccggaagtcagcgtgaaaccgtgcaggccgtgactgacggtgcgctcatcgacattacggatatgcgcgaatggcgtgaggagcgcgggcagggcgtagtgcataaaccgattcctggttggcagagtacgcttgagcaacgtgggtttgtcggctgtgcgcggcacttcattgaatgtgtgcaaaaccagacagttccgcaaaccgccggcgaacaggccgtgctggcgcaacgtatcgttgacaagatctggcgcgatgcgatgagtgaataa

SEQ ID NO: 192 - DNA, 720 bp, Escherichia coli
  CDS (1)...(720)
atgttaaagcgcgtgttcctcagcctgttagtcctgatcggcttgctgctgttgactgtgctcggcctcgatcgctggatgagctggaaaaccgcgccttatatctacgacgaattgcaggatctcccctaccgccaggtcggtgtggtgctcggaacagcaaaatattatcgtactggcgtaattaatcagtattatcgctaccgcattcaaggagcgattaatgcctataacagcggtaaggtaaattatctattactgagcggcgataacgcattgcaaagttataatgagccgatgaccatgcgcaaagatttaatcgctgctggtgtcgacccatcagatattgttctcgattacgcaggctttcgtacgctggattccatcgtgcgtacacgcaaagttttcgatactaatgatttcattattatcacccaacgtttccactgtgagcgagcattatttattgcgctgcatatggggattcaggctcagtgttatgccgtaccgtcaccgaaagatatgctgtcagtacgtattcgtgaatttgccgcccgtttcggtgcgctggctgacctttatatttttaaacgtgaaccgcgttttttagggccgctggtccctattccggctatgcaccaggtaccggaagatgcgcaggggtatcccgccgtcacacccgaacagttacttgaattacaaaagaaacaaggaaagtag

SEQ ID NO: 193 - DNA, 240 bp, Escherichia coli
  CDS (1)...(240)
atggatgtacagcagttttttgtcgttgccgtttttttccttatcccgatattttgtttccgcgaagcatggaaaggctggcgcgcaggcgcgattgataaacgggttaaaaatgcaccggaaccggtgtatgtctggcgagcaaaaaatcccggactctttttcgcttatatggtggcatatatcggcttcggaattttatctatcggcatgattgtttatcttattttctatcgttaa

SEQ ID NO: 194 - DNA, 1533 bp, Escherichia coli
  CDS (1)...(1533)
atggcgacgatcgattctatgaataaggacaccacacgtttgagcgatggacccgactggacgttcgacctgctggatgtttatctggcagagatagaccgggtggcgaaactctaccggctggatacctacccgcaccagattgaagtgataacctcagaacagatgatggatgcctactccagcgtcggcatgccaattaactatccgcactggtcattcggtaaaaagtttatcgagactgaacggctgtataagcacggtcagcaaggactggcctatgaaatcgtcattaactctaacccgtgtatcgcttacctgatggaagagaacaccattaccatgcaagcgctggtgatggctcatgcctgctatgggcataactctttcttcaaaaacaattacttattccgtagctggaccgacgccagttcgattgtcgattatctgatttttgcccgtaaatatattaccgagtgcgaagagcgttatggcgttgatgaagtagaacggcttctggactcgtgccacgcgctgatgaactacggcgtggaccggtacaaacgcccgcaaaaaatctcgctgcaagaagagaaagcccggcagaaaagtcgcgaagagtatctgcaaagtcaggtcaatatgctctggcgtaccctgccgaagcgcgaggaagagaaaacggttgctgaagcgcgccgctatccgtccgaaccacaagaaaacctgctctattttatggagaaaaatgcgccactgctggaatcatggcagcgtgaaatcctgcgtattgtgcgtaaggtgagccagtatttttatccgcaaaaacagactcaggtgatgaacgaaggctgggcgaccttctggcactacaccatccttaaccatctgtatgatgaagggaaagtaacggaacgttttatgctggagtttttgcacagccacaccaatgtggtcttccagcccccctataacagcccgtggtacagcggcatcaacccgtatgccctcgggttcgccatgttccaggatattaaacggatttgtcagtcgccaacggaagaagacaaatactggttcccggatatcgccggttccgactggctggaaacgctgcatttcgcgatgcgtgatttcaaagatgagagttttatcagccagttcctgtcaccgaaagtgatgcgtgatttccgcttcttcaccgtgctggatgacgatcggcataattatctggagatttccgctattcataatgaagaaggttatcgggagatccgtaaccggttatcgtcgcaatataacttaagtaatctggagccgaatattcagatctggaacgtggatttgcgcggcgaccgttcgctgacgctgcgttatattccacataatcgcgcaccgctggatcgggggcgcaaagaagtcctgaagcatgtgcatcgcctgtggggatttgatgtgatgctcgaacagcaaaacgaagacggcagcatcgagttgctggaacgttgcccgccaagaatgggaaatctgtaa

SEQ ID NO: 195 - DNA, 1359 bp, Escherichia coli
  CDS (1)...(1539)
atgaaaagactatctataaccgtccgtttaaccttgctttttatattgctactgtctgttgctggcgccggaattgtctggactctctataatggcctggcaagtgagttgaaatggcgcgatgatacaacactcattaaccggacagcgcagatcaagcagttgttaattgatggggtaaatccagatacgttacctgtgtactttaaccggatgatggatgttagtcaggatatcttgattattcatggtgatagcatcaataaaattgttaaccggacaaatgtcagtgatggcatgttaaataacatacctgctagtgagacaatcagcgcagctggcatttacagaagcattattaatgatacagagatagatgctttacgaattaatattgatgaagtttcgccatcattaacggttactgtggctaaattggcttcagccagacataacatgcttgaacagtataaaattaatagcattataatttgcattgtcgccattgtactttgctcagtattaagtccgctgttaatcagaacgggattacgagagatcaaaaagttgagtggtgtaacggaagcgctgaattataacgatagccgagagcctgttgaggttagcgcattaccgagagaactaaaacctcttgggcaggcgttgaataaaatgcatcatgctttagtcaaagattttgagcgtctaagtcagtttgctgacgatctcgctcatgaacttagaacgccaattaatgcattactgggtcagaatcaggttacgctcagtcaaaccagaagtatcgctgaatatcaaaaaacaattgccggaaacattgaagagctggaaaatatttcgcggttaacagagaacatactgtttcttgccagggcagataaaaacaatgttttggtgaaactggactcgctttctctcaataaggaagtcgaaaatttgttggactatcttgaatacctttcagacgagaaagagatttgctttaaggtcgagtgcaatcagcaaatctttgcggataaaattttactacaacgaatgttatcgaatcttattgttaatgccattagatattcgccagaaaaatcgcgtattcatataaccagttttcttgataccaacagctatcttaatattgatatcgccagccctggaacgaaaattaatgagcctgaaaaactcttccgtagattttggcggggagataattcgcgtcattccgtaggtcagggactaggcctttctttagtcaaagcgattgccgaattgcatgggggaagtgctacgtatcactatctcaataagcataatgtgttccggattacgttaccgcaaagaaattaa

SEQ ID NO: 196 - DNA, 720 bp, Escherichia coli
  CDS (1)...(720)
atgaaccaggctgtttctataacatatgatttatggcatattattttcatgaagattctacttattgaagataatcaaaggacccaggaatgggtaacgcaggggctttccgaagcgggttatgtcatcgatgccgtttctgatggcagagatgggctttatcttgcgctgaaggatgattatgcattgatcattctggatattatgcttccgggtatggatggctggcagatcttacaaacgttaagaacagcaaagcaaacccctgttatttgccttactgcaagggattctgtcgatgacagagtcagagggctggacagtggggcaaatgattatctggtaaaacctttttcattttctgagttgctggcaagggttcgggcacaattaaggcaacatcacgctttgaattcaacattagaaatcagcggcttaagaatggactctgttagtcatagtgtgagcagggacaatatcagtattacactgacgcgcaaggagtttcagttactttggctactggcctccagagctggcgaaattatacccagaacggttattgcgagtgaaatttggggaatcaactttgatagtgataccaatacggtggacgtcgccattcgcaggctccgcgcaaaagttgatgatccttttcctgaaaagctaattgccacaatccgggggatgggctattcattcgtagcggtaaaaaaataa

SEQ ID NO: 197 - DNA, 519 bp, Escherichia coli
  CDS (1)...(519)
atgattcttaaatcagctatttccgctgactctctgctcgctaaggatgcttttagggcatcctttcatttacactttttacgaaatcatgggatcactaacaaaatatcgcttgtcagttatattgtatggcaggaaagatatgcgactgatattacagatccccaaagtggagagtttatgaccattaaaaataagatgttgctgggtgcgcttttgctggttaccagtgccgcctgggccgcaccagccaccgcgggttcgaccaatacctcgggaatttctaagtatgagttaagtagtttcattgctgactttaagcatttcaaaccaggggacaccgtaccagaaatgtaccgtaccgatgagtacaacattaagcagtggcagttgcgtaacctgcccgcgcctgatgccgggacgcactggacctatatgggtggcgcgtacgtgttgatcagcgacaccgacggtaaaatcattaaagcctacgacggtgagattttttatcatcgctaa

SEQ ID NO: 198 - DNA, 825 bp, Escherichia coli
  CDS (1)...(825)
atgaccgaatttacaactcttcttcagcaaggaaacgcctggttcttcatccccagcgccatcttacttggtgcgcttcatggcctggaaccagggcactcaaaaacgatgatggcggcgtttatcatcgccatcaaaggcaccattaaacaagcggtgatgctcggactggcagcaactatttcgcataccgcagtggtctggttaattgcctttggcgggatggtgatcagcaagcgctttactgctcaatcagcagaaccgtggctccagctgatttccgcagtgatcattattagcaccgcgttctggatgttctggcgtacctggcgcggcgaacgcaactggctggagaatatgcacgggcatgattatgagcatcatcatcacgatcacgaacatcaccacgaccatggacatcatcaccatcacgaacatggcgagtatcaggatgcccatgcacgagcccatgccaatgacattaaacgacgctttgatggtagagaggtcaccaactggcaaattttgttatttggcttaaccggtggccttatcccctgcccggcagcaattaccgtgctgttgatatgcattcagttgaaagccctgacactgggcgcaacactggtcgtcagtttcagcattggcctggcgttaacgcttgtcaccgtaggcgttggcgcagcaatcagcgttcagcaggtcgcaaaacgctggagcggatttaacactctcgctaaacgcgccccctatttttccagtctgttgattggcttagtcggtgtgtatatgggcgtacatggcttcatgggcataatgcgataa

SEQ ID NO: 199 - DNA, 249 bp, Escherichia coli
  CDS (1)...(249)
atgtgtattggcgttccaggccaggtgctggctgtcggtgaagatattcaccagcttgcgcaggttgaagtatgtggtatcaagcgcgatgtgaatatcgccctgatttgtgaaggtaaccctgccgatctactgggccagtgggtgctggtacacgtcggatttgccatgagcatcatcgacgaagatgaagccaaagccacattagacgcactgcgccaaatggattacgacattaccagcgcgtga

SEQ ID NO: 200 - DNA, 342 bp, Escherichia coli
  CDS (1)...(342)
atgcatgagttgtctctttgccagagcgccgttgaaattatccaacggcaggcggagcagcacgatgttaagcgcgtcaccgccgtgtggctggaaattggcgcgctctcctgcgttgaggagagcgccgtccgttttagttttgaaattgtctgccacggaacggtggcgcaagggtgcgatttacatatcgtctataaacccgcccaggcttggtgctgggattgcagccaggtggtggagattcatcagcacgatgcgcagtgtccgctctgtcacggcgagcggttgcgtgtcgataccggcgattcgctgatcgtcaaaagtattgaagttgaataa

SEQ ID NO: 201 - DNA, 489 bp, Escherichia coli
  CDS (1)...(489)
atgactgaagagatagcaggtttccagacctccccgaaggcgcaagtacaggcagcgtttgaagaaattgcccggcgttcgatgcacgatctctcttttctgcatccttcaatgccggtgtatgtttctgattttacgctgttcgaaggtcagtggacggggtgtgtgatcaccccgtggatgctgagtgcagttatcttccccggcccggatcaactctggccgctgcgcaaagtgagtgaaaaaattggtctgcaactgccgtatggcactatgacctttaccgttggcgaactggacggtgtttcgcaatatctctcctgttcgctgatgtcgccgctttcgcacagcatgtcgattgaagagggccaacgcctgacggatgactgcgcacgaatgatcctttcgctgccagtcacgaatccggatgtaccacacgcagggcgtcgcgccctgctgtttggtcgcaggagtggcgaaaatgcatga

SEQ ID NO: 202 - DNA, 495 bp, Escherichia coli
  CDS (1)...(495)
atgcgtattttagtcttaggggtcggcaatattttgctgaccgatgaagccatcggtgtgcggattgtcgaagcgttagagcaacgatacattctgccggattatgttgagatcctcgatggcggcacggcgggaatggagctgcttggcgacatggcaaatcgcgatcatttgattattgcggatgccattgtctcgaaaaagaacgcgccgggaacgatgatgatcctgcgggatgaagaagttccggcgttgtttaccaacaaaatctctccgcatcagcttggcctggccgacgtcttgtcggccctgcgcttcaccggcgagtttccgaaaaagctgaccctggtcggcgtgatcccggaatcgctggagccacacatcggcttaacgccgacggttgaagcaatgattgaacctgcgcttgagcaggttctggctgcgctgcgtgaatctggcgtggaagccatcccacgggaggcgattcatgactga

SEQ ID NO: 203 - DNA, 1704 bp, Escherichia coli
  CDS (1)...(1704)
atgagccagagaattactattgatccggtaacccgtattgaggggcatttacgcatcgattgcgaaatcgaaaatggcgtcgtttcgaaagcatgggcttccggtaccatgtggcgcggcatggaagagatcgtgaaaaaccgcgatccgcgcgatgcatggatgattgtgcaacgtatctgtggcgtatgtactaccactcacgcgctgtcttccgttcgtgcggcagaaagtgcgctgaatatcgacgttccggttaacgcgcaatacatccgtaacatcattctggctgcgcacaccacgcatgaccatattgttcatttctatcagctttcggcgctggactgggtggacatcacttctgcactgcaagctgacccaaccaaagcctccgaaatgctgaaaggcgtttcgacctggcacctgaacagtccggaagagttcaccaaagttcagaacaagatcaaagatctggttgccagcggtcagttgggtattttcgctaatggctactggggtcatccggcgatgaaactgccgccggaagtgaacctgattgcggtagcgcactacctgcaagcgttggagtgccagcgtgacgctaaccgcgtcgtggcgctgctgggcggtaaaacgccgcacattcagaacctggcggtaggtggtgtcgcgaacccgatcaacctcgacggtttgggcgtgctgaaccttgagcgcctgatgtacatcaagtctttcatcgacaaactgagcgactttgttgagcaggtttataaggttgataccgcagttattgccgcgttctacccggaatggctgacacgcggtaaaggtgcggtgaactacctgagcgtgccggaattcccgaccgacagtaaaaacggcagcttcctgttcccgggcggctacattgagaatgcggatctgtcctcgtatcgtccgatcacttctcattccgatgaatacctgatcaaaggcattcaggaaagcgcgaagcactcctggtataaagacgaagcgccgcaggcaccgtgggaaggcaccaccattccggcttatgatggttggtctgacgacgggaaatattcctgggtgaaatcaccgactttctacggcaaaacggtagaagtggggccactggctaatatgctggtgaaactggcggcaggtcgcgaatctacccagaacaaactgaatgaaatcgttgcgatttatcagaaactgactggcaacacgctggaagtggcacagctgcactccacgctgggccgtattattggtcgtaccgttcactgctgtgaattgcaggatatcctgcaaaaccaatacagtgcactgatcaccaatatcggcaaaggcgatcacaccacctttgtgaagccgaacattccggcaacgggtgaattcaaaggtgttggcttcctcgaagcgccgcgcggtatgctctctcactggatggttattaaagacggtatcatcagcaactaccaggcggttgttccatcaacctggaactctggtccgcgtaacttcaatgatgacgtcggtccttacgagcagtcgctggtgggtacaccggttgccgatccgaataaaccgctggaagtggtgcgtaccattcactcctttgacccgtgcatggcctgtgcggtacacgtagtggatgctgacggcaacgaagtggtttcagtgaaggttctgtaa

SEQ ID NO: 204 - DNA, 1179 bp, Escherichia coli
  CDS (1)...(1179)
atgagtcatgatccacaaccgctgggcggcaaaatcatcagtaaaccggtcatgatttttggaccgttaatcgtcatctgtatgctcctgattgtgaagcgtctggtgttcggtctgggctctgtctctgacctgaacggcggcttcccgtggggcgtgtggatcgcgtttgacctgctgattggcaccggctttgcctgtggcggctgggcgctggcgtgggcggtatacgtctttaaccgtgggcaataccatccgctggtgcgtccggcgctgttggcgagtctgtttggttactcactgggtggcttgtcgatcactatcgacgtgggtcgctactggaacctgccgtacttctacattccgggtcacttcaacgtgaactcggtactgttcgagacggcggtctgtatgaccatctatatcggcgtgatggcactggagtttgctccggcactgtttgaacgtctggggtggaaggtgtcgctacagcgactaaacaaggtgatgttcttcatcatcgcgctcggtgcgctgctgccgaccatgcaccagtcttcaatggggtcgctgatgatctcggcgggctacaaggtgcatccgttgtggcagagctatgaaatgttgccgctgttctcgctgctgacggcgttcatcatgggcttctcgattgtcatctttgaaggttcgctggtgcaggcgggtctgcgtggcaacggtccggatgaaaagagtctgtttgttaagctgaccaacaccatcagtgtgttgctggcgattttcatcgtgctgcgctttggcgagcttatctatcgcgacaagctgtcgttagcgtttgccggtgacttctactccgtgatgttctggattgaagtcctgctgatgctcttcccgctggtcgttctgcgtgtggcgaagctgcgtaatgattcccgcatgctgttcctgtcagcactgagcgcactgttaggttgtgcaacctggcgtctgacctattcgctggtggcattcaacccgggcggcggttacgcctacttcccgacctgggaagaactgttgatttctattggttttgtggctattgagatttgcgcttacatcgtactcattcgtctactgccgatacttcctcctttaaaacaaaacgatcataatcgtcatgaggcgagcaaagcatga

SEQ ID NO: 205 - DNA, 987 bp, Escherichia coli
  CDS (1)...(987)
gtgaacagacgtaattttattaaagcagcctcctgcggggcattgctgacgggcgcgctgccgtctgtcagtcatgcggctgctgaaaaccgcccgccaattccgggatcgctggggatgttgtacgactcgaccttgtgcgtaggctgccaggcttgcgtcaccaagtgtcaggatatcaatttccctgaacgtaacccgcaaggggaacagacctggtcgaacaacgacaaactgtcgccgtataccaataacatcattcaggtgtggaccagcggcacaggggtcaacaaagaccaggaggagaacggctacgcgtacattaagaaacagtgtatgcactgcgtcgatccgaactgtgtctctgtgtgcccggtctctgcactgaaaaaagatccgaaaaccggcattgtccattacgacaaagatgtgtgcaccggctgccgttactgcatggtcgcctgtccgtacaacgtgccgaagtacgactacaacaacccgtttggtgcgctgcataagtgcgagctgtgcaaccagaaaggtgtggaacgtctcgataaaggcggtctacctggctgcgtagaagtgtgcccggcgggcgcggtgattttcggtacgcgtgaagagctgatggcggaggcgaaaaaacgtctggcgctgaagcctggcagcgaataccactatccgcgtcagacgctgaaatctggcgacacttacctgcatacggtgccgaaatattatccgcatctgtacggcgagaaagagggcggcggtactcaggttctggtactgacgggtgtgccttatgaaaatctcgacctgccgaaactggacgatctttctaccggtgcgcgttccgaaaatattcaacacaccctgtataaaggcatgatgctaccactggctgtgctggcgggcttaaccgtgctggttcgtcgcaacaccaaaaacgaccatcacgacggaggagacgatcatgagtcatga

SEQ ID NO: 206 - DNA, 2475 bp, Escherichia coli
  CDS (1)...(2475)
atgctacaatgtggcgcgaagaatgttaaccctctggagcgttttgtgtcgtcgttgcccgttgctgccgtcttacctgaattacttaccgctctcgattgtgcgccgcaggtattattaagtgcgccgaccggggccgggaaatcaacctggctgccgctgcaactgctggcgcatcccggcattaacgggaaaattatcctgctggagccgcgtcgtctggcggcgcgtaacgtcgcgcaacggctggcggagctgcttaacgaaaagccaggcgataccgttggctaccggatgcgtgcgcaaaactgcgtcgggccgaatacccgcctggaagtggttaccgaaggcgtgctgacgcgcatgatccagcgtgacccggaactgagcggtgttggactggtgatccttgatgaatttcatgagcgcagcttgcaggcggatttggcgttggcgctgttactcgatgtgcaacaaggtctgcgtgatgaccttaaactgctgattatgtcggctaccctggacaacgaccgcttgcagcaaatgctgccagaagcgcctgtcgtcatctcagaagggcgctcgtttccggttgaacgccgttatttaccgctgcccgcgcatcagcgttttgacgatgccgttgcggtagccaccgctgaaatgctgcgtcaggaaagcggatcattactgttatttttacctggcgtcggagaaattcagcgtgtgcaggaacaactggcttcgcgcatcggcagtgatgtattgctctgcccgctgtatggcgcgttgtcgctgaacgatcagcgaaaagcgatcctcccggcaccgcaagggatgcgcaaagtggtgctggcgaccaatattgctgaaaccagtttaaccattgaaggtattcgtctggtggtggattgtgcccaggagcgtgtggcgcgttttgatccgcgcacggggcttacgcgactgattactcaacgcgttagccaggcatccatgacgcagcgtgccgggcgcgccgggcgtctggagccgggtatcagcctgcatttaatcgccaaagaacaagcagaacgcgccgcggcgcaaagtgaaccggagatcttacaaagcgatctttccggtttgctgatggaattactgcaatggggatgcagcgatccggcgcagatgagctggctggatcaaccgccagtagtgaatctactggccgcgaaacgtctgttacaaatgctgggggcactggagggtgaacggcttagtgcgcaagggcaaaaaatggcagcgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaaccagcctggcagcaacgtagtcagcaactgttaaaacgcttaaacgtacgtggcggtgaggcagacagttcgcttatcgcgccgctacttgccggggcgtttgccgatcgcattgctcgtcgccgtgggcaagatggacgctatcaactggcaaacggcatgggagcgatgctcgatgccaacgacgcgctaagccgccacgaatggttgatcgcaccgttattattgcagggcagcgcctcgccggatgcgcggattttactggcgctgctggtcgatattgatgagttagtacaacgctgcccgcagctggtacagcagtctgacactgtggagtgggatgacgcgcaaggtacgctgaaagcctggcgtcggctacaaatcggtcagttgacggtgaaagtgcagccgctggcgaaaccgtcagaagacgagttgcatcaggcgatgcttaatggcatccgtgataaaggtttaagcgtgctcaactggacggcggaagcggaacagctacgcttgcgtttgttatgcgccgcaaagtggttgccggaatatgactggccagcggttgatgatgaaagtttattggcagcgctggaaacgtggctgctgccacatatgactggcgtacattcactacgcggcctgaaatcactcgacatttatcaggcactacgcggattacttgattggggaatgcagcaacgtctggatagtgaattgcctgcgcattacactgtgccgacgggaagccggatcgccattcgttatcatgaagataacccgcccgcgctggcggtgagaatgcaagagatgtttggcgaggccaccaatccgacgatcgcccaggggcgcgtgccgctggtgctggagttgctttcacctgcccaaaggccattacaaatcacacgagatttgagcgacttctggaaaggagcgtaccgtgaggtgcaaaaagagatgaaagggcgttatcccaaacatgtctggccggacgacccggcaaatactgcaccgacgcgacggacgaaaaagtattcgtaa

SEQ ID NO: 207 - DNA, 951 bp, Escherichia coli
  CDS (1)...(951)
atgagtaaacttgatacttttatccaacatgctgtaaacgctgttccggtcagtggcacatctttgatctcctctctgtatggtgattcgctttcccatcgtggtggtgaaatctggttgggtagtctggctgctttgctggaagggctgggatttggtgagcgtttcgtgcgcaccgctttgtttcgtcttaataaagaaggctggctggatgtttcccgcatcgggcgacgcagtttctatagcctcagtgataaaggcttgcgcctgacgcgacgggcagaaagtaaaatttatcgcgcagagcaacctgcatgggatggtaaatggctcctgttgctctcggaaggtttagataaatcaacgctggctgatgtcaaaaagcagttgatctggcaaggttttggcgcactggcacccagcctgatggcatcgccgtcgcaaaaactggccgatgtacagacacttttgcatgaagcgggtgtggcggataacgtgatttgttttgaagcgcaaataccactggcgctttctcgcgcagcactgcgtgccagagtagaagagtgctggcatttaactgaacaaaatgccatgtacgaaacctttattcagtcattccgcccgctggtgccgcttttaaaagaggcggcagacgagttaaccccggagcgggcatttcatattcagcttttactgatccatttttatcgccgtgtcgtccttaaagacccattgttgccggaggagttgcttccggcacactgggcagggcatacggcgcgtcagctgtgtatcaacatttatcagcgcgtagcgcctgctgctttagcgttcgttagtgaaaaaggtgaaacctcggtcggtgaactgcctgcgccgggaagcctgtattttcaacgttttggcggcttgaatattgaacaggaggcgttatgccaatttatcagatag

SEQ ID NO: 208 - DNA, 591 bp, Escherichia coli
  CDS (1)...(591)
atgccaatttatcagatagacggtctgactccggttgtgccagaagagagttttgtccatccgacagcggtattgatcggcgatgttattctcggcaagggcgtttacgttgggccaaatgccagcctgcgtggcgattttggtcgtatcgtggtgaaagatggcgcgaacattcaggataattgcgttatgcacggttttcccgagcaggatactgttgtaggagaagatggacatattggtcatagcgctatccttcacggctgcattatccgccgcaatgcattagtgggaatgaacgcggtagtgatggacggtgcggtgattggcgagaacagcattgttggtgcatccgcatttgtgaaagccaaagcagaaatgccagctaattacctgattgtcggcagcccggcgaaagcgattcgtgaactcagtgagcaggagttggcatggaaaaagcagggtacgcatgagtaccaggtgctggtgacacgctgtaagcagacgttacatcaagtcgagccattgcgggaaattgaacctggcaggaaacgcctggtatttgatgagaatctgcgaccgaaacagtaa

SEQ ID NO: 209 - DNA, 1281 bp, Escherichia coli
  CDS (1)...(1281)
gtgaaacatctgacagaaatggtgagacagcacaaagcgggcaaaacaaatggaatttatgccgtttgttccgcacatccgctggtgctggaagctgcaatccgctacgccagtgcaaaccaaacgccgttactgattgaagcaacctccaatcaggtagaccagttcggcggttataccggaatgacgcccgccgattttcgcggctttgtttgtcagctcgccgactcgttgaatttcccgcaggatgcgttgattctgggtggtgaccatctggggccaaaccgctggcaaaacctgccggccgctcaggcaatggccaatgccgatgatttgattaaaagctacgttgcggcaggattcaaaaaaatccaccttgattgcagcatgtcctgtcaggacgatccgattcccttaactgatgacatcgtggctgaacgcgccgcccgtctggcgaaagtggcggaagaaacctgtcttgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcctttgaaaagcaaggtttgaatgccatctggccacgcatcattgccctggtggttcaacccggcgtcgaattcgatcacaccaacgttattgattatcagcccgccaaagcgagcgccttaagccagatggtcgaaaactacgaaacgctgattttcgaagcgcactctaccgattatcaaacgccgcaatcgctgcgccagctggtgattgaccactttgccattctgaaagttggcccagcgctgaccttcgccctgcgtgaagctctgttctctctggcggcgattgaagaagaactggtgccagcgaaagcctgttctggtctgcgtcaggtgctggaagacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggtacgtaatctggcggattcaccaattccgctgccgctgatcagccagtatctgccgctgcagtacgtgaaagttcgctccggcgagctgcagccaacgccacgggaactcattatcaaccatattcaggacatcctggcgcagtaccacacagcctgtgaaggccaataa

SEQ ID NO: 210 - DNA, 510 bp, Escherichia coli
  CDS (1)...(510)
gtgaaggccaataagcaaaacaaagaggaacacgctatgccaaatattgttttaagccggattgatgaacgcttgattcacggtcaggtcggcgttcaatgggtcggatttgcgggggcaaatctggtgctggtagccaacgatgaggttgccgaagatccggtacaacaaaacctgatggaaatggtactggcagaagggatcgccgtacgtttctggacgctgcaaaaagttatcgacaacattcatcgcgccgccgatcgacagaaaatcctgctggtttgtaaaacacccgccgatttcctgacgctggtgaaaggtggcgttccggtgaatcgcattaacgttggcaatatgcactacgccaatggcaaacaacaaatcgccaaaacggtttctgtggatgcgggcgatatcgcagcatttaacgacctgaaaaccgctggggtggaatgcttcgttcagggcgtcccgacagagcctgctgtggacctctttaaattactttga

SEQ ID NO: 211 - DNA, 402 bp, Escherichia coli
  CDS (1)...(402)
atggaaatcagcctgttgcaggcatttgcgttgggcattatcgcctttatcgctggcctggatatgtttaacggcctaacccatatgcaccgcccggtggtcctcggcccgttggtcgggctggtacttggcgatctgcataccggaattttaaccggcggtacgctggaactggtgtggatggggctggccccgctggcgggcgcacagccgcctaacgtgattatcggtactatcgtcggcacggcgtttgccattactactggcgtgaaacccgatgtcgcagtaggtgtcgccgtacctttcgctgtcgcagtacagatggggattaccttcctgttctcggtgatgtccggcgtgatgtctcgctgcgacctggcaacaaacccgcgccgcatttga

SEQ ID NO: 212 - DNA, 504 bp, Escherichia coli
  CDS (1)...(504)
gtgcattgctataacgggatgacaggtttacatcaccgcgaaccgggaatggttggcgcgggattaacggacaagcgcgcctggctggaactgatagccgatggtcatcatgtgcatccggcggcaatgtcgctgtgttgttgctgtgcgaaagagagaatcgtactgatcaccgacgcgatgcaggcagctgggatgccggatggtcgctatacgttatgtggtgaagaagtgcagatgcacggtggcgttgtccgtaccgcgtctggtgggctggcgggcagtacgctgtctgttgatgcggcagtgcgcaatatggtcgagttgacgggcgtaacgcctgcggaagccatccatatggcgtcgctgcatccggcgcgaatgctgggtgttgatggtgttctgggatcgcttaaaccgggcaaacgcgccagagtcgttgcgctggatagcgggctacatgtgcaacaaatctggattcagggtcaattagcttcgttttga

SEQ ID NO: 213 - DNA, 1155 bp, Escherichia coli
  CDS (1)...(1155)
atgccagaaaattacacccctgctgccgccgcaaccggtacatggactgaagaagagatccgccatcagcctcgcgcatggatccgttcactcaccaacatcgacgcgctacgttccgcgctcaataacttccttgaaccgttactgcgcaaagagaatctgcggatcatcctgaccggagccggaacgtcggcatttatcggtgacatcatcgcgccgtggctcgccagccataccggtaaaaacttcagcgccgtaccgaccaccgatctggtcaccaatccgatggactacctgaacccagctcatccgctgctgttgatctccttcggtcgatccggcaacagcccggaaagcgtcgcagccgtggaactggcaaatcaatttgtaccggaatgctatcacctgccgatcacctgcaacgaagcgggcgctctttaccaaaacgcgatcaacagcgataacgcgtttgccctgctgatgcccgcagaaacgcacgatcgcggctttgcgatgaccagcagcattaccaccatgatggccagctgcctcgcggttttcgcacctgagacgatcaacagccaaaccttccgcgacgtggcggatcgttgccaggcgatcctgacctcactgggcgatttcagcgaaggtgtgtttggttacgcaccgtggaaacggatcgtttatctcggtagcggtggcttacagggcgcagcacgcgagtcggcgctgaaagtgctggaactgacggcgggtaaactggcggccttttatgattctccaaccggattccgtcatggaccaaaatcgctggtcgatgacgaaacgctggtggtggtatttgtctccagccacccttacacccgtcagtatgatcttgatctgctggctgaacttcgccgtgacaaccaggcaatgcgtgtaatcgccatcgccgcggaaagcagcgacatcgtcgctgccggtccacatatcatcctgccaccgtcacgtcactttatcgacgttgagcaggcattttgcttcctgatgtacgcccagacgtttgcactgatgcagtcgctgcacatgggcaatacgccggataccccatcagccagtggcaccgttaaccgcgtggtgcaaggcgtaatcattcatccgtggcaggcataa

SEQ ID NO: 214 - DNA, 861 bp, Escherichia coli
  CDS (1)...(861)
atgagcattatctccactaaatatctgttacaggacgcccaggccaatggctacgcggtgcctgcttttaacattcataacgccgagacgatccaagcgatcctcgaagtgtgcagtgaaatgcgatcgccggtgatcctcgccggaacgccggggacctttaaacacatcgcgctggaagagatctacgccctgtgtagcgcctattccacaacctacaacatgccactggcgctgcatctcgaccaccacgaatcgctggatgatattcgccgtaaagtccacgcaggtgtgcgcagtgcgatgatcgacggcagccacttcccgtttgccgagaacgtgaagctggtgaaatcggttgttgacttctgccactcacaagattgcagcgtggaagcagaactgggccgcctgggcggtgttgaagatgacatgagcgttgacgccgaaagtgcattcctgaccgatccacaagaagctaaacgctttgtcgaactgactggcgtcgacagcctggcggtagcgattggtacggcgcacggcttatacagcaaaacgccgaagattgatttccagcggctggcggaaattcgtgaagtggtggatgttcctctggtgctgcatggtgccagcgatgttccggatgaatttgtccgtcgcactattgaacttggcgtcacaaaagtgaacgttgccacagaattaaaaatagccttcgctggcgcggttaaagcctggtttgcggaaaatccgcagggtaatgatcctcgttattatatgcgcgtcggaatggatgcgatgaaagaagttgtcagaaataaaattaatgtctgtggttcagcgaatcgaatttcagcataa

SEQ ID NO: 215 - DNA, 357 bp, Escherichia coli
  CDS (1)...(357)
gtggcccgtatagcaggcattaacattcctgatcataagcatgccgtaatcgcattaacttcgatttatggcgtcggcaagacccgttctaaagccatcctggctgcagcgggtatcgctgaagatgttaagatcagtgagctgtctgaaggacaaatcgacacgctgcgtgacgaagttgccaaatttgtcgttgaaggtgatctgcgccgtgaaatcagcatgagcatcaagcgcctgatggatcttggttgctatcgcggtttgcgtcatcgtcgtggtctcccggttcgcggtcagcgtaccaagaccaacgcacgtacccgtaagggtccgcgcaaaccgatcaagaaataa

SEQ ID NO: 216 - DNA, 390 bp, Escherichia coli
  CDS (1)...(390)
atggcaaaggcaccaattcgtgcacgtaaacgtgtaagaaaacaagtctctgacggcgtggctcatatccatgcttctttcaacaacaccatcgtgactatcactgatcgtcagggtaacgcgttgggttgggcaacagccggtggttccggtttccgtggttctcgcaaatccactccgtttgcagctcaggttgcagcagagcgttgcgctgacgccgtgaaagaatacggcatcaagaatctggaagttatggttaaaggtccgggtccaggccgcgaatctactattcgtgctctgaacgccgcaggtttccgcatcactaacattactgatgtgactccgatccctcataacggttgtcgtccgccgaaaaaacgtcgcgtataa

SEQ ID NO: 217 - DNA, 621 bp, Escherichia coli
  CDS (1)...(621)
atggcaagatatttgggtcctaagctcaagctgagccgtcgtgagggcaccgacttattccttaagtctggcgttcgcgcgatcgataccaagtgtaaaattgaacaagctcctggccagcacggtgcgcgtaaaccgcgtctgtctgactatggtgtgcagttgcgtgaaaagcaaaaagttcgccgtatctatggtgtgctggagcgtcagttccgtaactactacaaagaagcagcacgtctgaaaggcaacaccggtgaaaacctgttggctctgctggaaggtcgtctggacaacgttgtataccgtatgggcttcggtgccactcgtgcagaagcacgtcagctggttagccataaagcaattatggtaaacggtcgtgttgttaacatcgcttcttatcaggttagtccgaatgacgttgtaagcattcgtgagaaagcgaagaagcagtctcgcgtgaaagccgctctggagctggctgagcagcgtgaaaagccaacctggctggaagttgatgctggcaagatggaaggtacgtttaagcgtaagccggagcgttctgatctgtctgcggacattaacgaacacctgatcgtcgagctttactccaagtaa

SEQ ID NO: 218 - DNA, 990 bp, Escherichia coli
  CDS (1)...(990)
atgcagggttctgtgacagagtttctaaaaccgcgcctggttgatatcgagcaagtgagttcgacgcacgccaaggtgacccttgagcctttagagcgtggctttggccatactctgggtaacgcactgcgccgtattctgctctcatcgatgccgggttgcgcggtgaccgaggttgagattgatggtgtactacatgagtacagcaccaaagaaggcgttcaggaagatatcctggaaatcctgctcaacctgaaagggctggcggtgagagttcagggcaaagatgaagttattcttaccttgaataaatctggcattggccctgtgactgcagccgatatcacccacgacggtgatgtcgaaatcgtcaagccgcagcacgtgatctgccacctgaccgatgagaacgcgtctattagcatgcgtatcaaagttcagcgcggtcgtggttatgtgccggcttctacccgaattcattcggaagaagatgagcgcccaatcggccgtctgctggtcgacgcatgctacagccctgtggagcgtattgcctacaatgttgaagcagcgcgtgtagaacagcgtaccgacctggacaagctggtcatcgaaatggaaaccaacggcacaatcgatcctgaagaggcgattcgtcgtgcggcaaccattctggctgaacaactggaagctttcgttgacttacgtgatgtacgtcagcctgaagtgaaagaagagaaaccagagttcgatccgatcctgctgcgccctgttgacgatctggaattgactgtccgctctgctaactgccttaaagcagaagctatccactatatcggtgatctggtacagcgtaccgaggttgagctccttaaaacgcctaaccttggtaaaaaatctcttactgagattaaagacgtgctggcttcccgtggactgtctctgggcatgcgcctggaaaactggccaccggcaagcatcgctgacgagtaa

SEQ ID NO: 219 - DNA, 384 bp, Escherichia coli
  CDS (1)...(384)
atgcgccatcgtaagagtggtcgtcaactgaaccgcaacagcagccatcgccaggctatgttccgcaatatggcaggttcactggttcgtcatgaaatcatcaagacgactctgcctaaagcgaaagagctgcgccgcgtagttgagccgctgattactcttgccaagactgatagcgttgctaatcgtcgtctggcattcgcccgtactcgtgataacgagatcgtggcaaaactgtttaacgaactgggcccgcgtttcgcgagccgtgccggtggttacactcgtattctgaagtgtggcttccgtgcaggcgacaacgcgccgatggcttacatcgagctggttgatcgttcagagaaagcagaagctgctgcagagtaa

SEQ ID NO: 220 - DNA, 732 bp, Escherichia coli
  CDS (1)...(732)
atgaagatgttgcgcgatccgctgttctggctcattgctctgtttgtggcgctgattttctggctgccttacagccagccgctgtttgctgccttgttcccacaactgccacgacccgtttatcagcaagaaagttttgcagctctggcactggctcatttctggctggtgggaatttcgagtttgtttgcggtgatcattggcactggtgccggaattgctgtcactcgcccgtggggcgcggaatttcgcccactggtggaaactattgccgccgttggacagacttttccgcccgtcgcagtgctggcgatcgccgttccggtgatcggctttggtctgcaaccagcgattatcgccttgatcctttacggtgtgctgcccgtcctgcaggcgacacttgccgggctgggagcgattgatgccagcgtgacagaagttgcgaaaggtatgggaatgagtcgtggtcagcgagtgcgtaaggtcgagctaccgctggcggctccggtgattctggcgggcgtgcgaacttcggtgattatcaacattggtacggcgacgatcgcctcaacggtaggggccagcacgctgggtacgcccatcatcatcgggcttagcggatttaataccgcgtatgtgatccagggggcgttactggtggcactggcggcgatcatcgcagaccgcctgtttgaaaggctggtgcaggcgcttagccagcacgcaaaataa

SEQ ID NO: 221 - DNA, 927 bp, Escherichia coli
  CDS (1)...(927)
atgattgaatttagccatgtcagcaaactgttcggcgcacaaaaagccgttaacgatctcaatctcaattttcaggaagggagtttttcggtgctgattggcacatctggctccggcaaatccaccaccctgaaaatgattaaccgcctggtggagcatgacagcggagagatccgctttgccggagaagaaattcgctcgctgccagtactggagttgcgccgccggatgggctatgccattcaatctattggcctgttcccccactggagcgtggcgcaaaacatcgctaccgtgccgcaattacaaaaatggtcgcgggcgcggattgacgatcgtatcgacgaattaatggcgctactggggctggagtcaaatttgcgtgagcgttatccgcatcagctttccggtggtcagcagcaacgtgtgggagtggcgcgtgcactggctgccgatccgcaagtcttactaatggatgaaccttttggcgcactggacccggtaacgcgcggcgcgttgcaacaagagatgacgcgcattcaccgtttgctggggcgtaccattgtgctggtcactcatgatattgatgaggcgctacggctggcagaacatctggtattgatggatcacggtgaagtagtgcagcagggcaatccgctgacgatgctgactcgtccggcgaatgattttgtccgccagttttttggacgtagtgaactgggtgtgcgcctgctttcgttacgtagtgtggcggattacgtgcgtcgcgaagaacgagcagatggtgaggcactggcagaagagatgacgctacgcgatgcgctctctctgtttgttgcgcggggatgcgaggtgctgccggtggtgaacatgcagggccagccttgcggcacgctgcattttcaggatctgctggtggaggcgtaa

SEQ ID NO: 222 - DNA, 1158 bp, Escherichia coli
  CDS (1)...(1158)
gtgacttatttccgtattaatcctgttctggcgctgctgctgttgctgacggcaatcgcagcggcgctgccgtttatcagttacgcgcctaatcgtttagtttcgggtgaggggcgtcatctctggcagctgtggccgcaaacgatctggatgctggtgggcgttggttgcgcctggctgacggcctgttttattcccggtaaaaaaggcagcatttgtgcactcattctggcgcaattcgtcttcgtattgctggtgtggggagctggaaaggcggcgacccaactggcgcaaaatggcagtgcgctggcgcgtaccagcctcggcagtggtttctggctggctgcggcgctggcattgctggcctgtagcgatgccatccgccgaatctccacgcatccgctgtggcgctggttgttgcatatgcagattgccattattccgctgtggttgctgtactccggcacgcttaacgatctctcactaatgaaagaatacgccaaccgtcaggatgtgtttgacgacgcgctggcacaacatctgacgttgctgtttggtgcggtgctgcctgcgttagtgattggtgtgccgttgggcatctggtgctacttttccactgctcggcagggggcaattttttctctgctcaatgtgattcagaccgtgccttcggtggcgctctttggcctgttgattgcgccgcttgccgcgctggttacggcctttccgtggctggggacgctcggcatagcaggaaccggaatgacacccgcactgattgcgctggtgctctatgccttgctgccgctggtgcgcggcgtggtagtcggtttgaaccagatcccgcgcgatgtgctggaaagcgccagagcgatggggatgagcggggcgcagcgtttcctgcatgttcagttaccgctggcgttaccggtatttctgcgcagcctgcgggtggtgatggtgcaaactgtaggtatggcggtgattgcggcgttaatcggcgcaggcggttttggtgcgctggttttccaggggctgctaagcagcgccattgatttagtgttgctgggggtgatcccggtaattgttctggcggtgcttaccgacgcgctgttcgatttgcttatcgcactgctgaaggtgaaacgtaatgattga

SEQ ID NO: 223 - DNA, 918 bp, Escherichia coli
  CDS (1)...(918)
atgccactcttaaagctctgggcaggttcactggttatgttggcagccgtgagcctgccgctacaggcggcttcccccgttaaagtcggttcaaaaatcgataccgaaggtgcgctactcggcaatatcattttgcaggtgctggaaagccacggcgtaccgacggtgaataaagtgcaactcggaacgactcctgtggtgcgcggggcgattacttccggtgaactggatatctatccggaatataccggcaatggcgctttcttctttaaagatgaaaacgatgcagcgtggaaaaacgcgcagcaaggttacgagaaagtcaaaaagctcgattcggagcacaacaagttaatctggctgacgcccgcgcctgcaaataacacctggactatcgccgtgcgtcaggatgtggcagagaaaaataaactcacttcgcttgccgacctgagtcgttatctgcaagagggcggcaccttcaaactggcagcctcggcagagtttatcgaacgcgccgatgcgttacccgcgtttgaaaaagcctatggctttaagctcggtcaggatcagttgctgtcactggctggtggcgacacggcggtgacgatcaaagccgctgcccagcaaacctctggcgttaatgctgcaatggcttacggcactgacggcccggtagcggcgctggggctgcaaaccttaagcgatccgcaaggtgtgcaacctatctacgcgcctgcaccagtggtgcgtgagtccgtgttgagggagtatccgcaaatggcacagtggctacagccagtcttcgccagcctcgatgcaaaaacattgcagcaactgaatgccagcattgctgtggaaggactggatgccaaaaaagtggctgccgactacctgaaacaaaaagggtggacgaagtaa

SEQ ID NO: 224 - DNA, 624 bp, Escherichia coli
  CDS (1)...(624)
atgctcgtctattggctggatatagtcggcacagcggtatttgccatctccggcgttttgttagccggaaaattgcgtatggacccttttggtgttctggtactgggcgtggtaaccgcagtaggcggcgggacaattcgcgacatggcgctggatcacggcccggtattttgggtgaaagatcccaccgatctggtcgttgcaatggtcaccagcatgctgaccatcgtgctggtgcgccagccaagacgcttaccaaaatggatgttgccggtgctggacgccgttggtctggcggtgtttgtcggcattggcgtgaataaagcctttaatgcggaagccggtccgttaatcgcggtttgtatgggcgtcattactggcgttggcggcgggatcattcgtgatgttctggcccgcgaaatccccatgattttacgtacagaaatctacgcaactgcctgtattatcggcggtattgtccacgctacggcttattacacattttccgtaccactggaaacagccagtatgatgggcatggtcgtgacgctattgattcggctggcggctattcgttggcatcttaagctaccgacgtttgcgctggatgagaatgggcgttga

SEQ ID NO: 225 - DNA, 801 bp, Escherichia coli
  CDS (1)...(801)
atggctaagtcactgttcagggcgctggtcgccctgtcttttcttgcgccactgtggctcaacgccgcgccgcgcgtcatcacgctttctcccgccaacactgaacttgcctttgccgccgggatcacgccggttggggtcagcagctattccgactatcctccacaagcgcaaaagattgagcaggtttccacctggcaggggatgaatctggaacgcattgtcgcgctgaaacccgatctggtgattgcctggcgtggaggtaatgccgagcggcaggttgaccagctggcttcgctgggaataaaagtgatgtgggtcgatgcgacaagcattgaacaaattgccaatgcgttacgtcaactggccccctggagtccgcaaccagacaaggccgaacaagccgcgcaatccctgctggatcagtacgcgcaattgaaagcgcaatatgctgataaacctaaaaaacgtgtttttctgcaattcggcattaatccgccatttaccagtggaaaagagtcgattcagaaccaggtactcgaagtttgtggcggagaaaacatctttaaagacagccgggttccctggccgcaagttagccgcgaacaggtgttagcacgctcgccacaggcgattgtcattacaggcggaccggaccaaattcctaaaatcaaacaatactggggtgaacagctcaaaattcccgttattcctctcacgagtgactggtttgaacgtgcaagcccacgtattatcctcgctgcacaacagctctgtaatgcgctttcacaggtagattag

SEQ ID NO: 226 - DNA, 699 bp, Escherichia coli
  CDS (1)...(699)
atgaaaatcggcatcattggtgcaatggaagaagaagttacgctgctgcgtgacaaaatcgaaaaccgtcaaactatcagtctcggcggttgcgaaatctataccggccaactgaatggaaccgaggttgcgcttctgaaatcgggcatcggtaaagtcgctgcggcgctgggtgccactttgctgttggaacactgcaagccagatgtgattattaacaccggttctgccggtggcctggcaccaacgttgaaagtgggcgatatcgttgtctcggacgaagcacgttatcacgacgcggatgtcacggcatttggttatgaatacggtcagttaccaggctgtccggcaggctttaaagctgacgataaactgatcgctgccgctgaggcctgcattgccgaactgaatcttaacgctgtacgtggcctgattgttagcggcgacgctttcatcaacggttctgttggtctggcgaaaatccgccacaacttcccacaggccattgctgtagagatggaagcgacggcaatcgcccatgtctgccacaatttcaacgtcccgtttgttgtcgtacgcgccatctccgacgtggccgatcaacagtctcatcttagcttcgatgagttcctggctgttgccgctaaacagtccagcctgatggttgagtcactggtgcagaaacttgcacatggctaa

SEQ ID NO: 227 - DNA, 789 bp, Escherichia coli
  CDS (1)...(789)
gtgattgataaatccgcctttgtgcatccaaccgccattgtggaagagggcgcgtcaattggcgcgaacgcacacattggtcctttttgtatcgttggaccccatgtcgaaattggtgagggtaccgtactgaaatctcacgttgtcgtgaatggtcatactaaaattggccgcgataatgagatttatcagttcgcctccatcggcgaagttaaccaggatctgaaatatgctggcgaaccgacccgtgtggaaatcggcgatcgtaaccgcattcgcgaaagcgtcaccattcatcgtggcacagtccagggcggtggattgacgaaggtgggcagcgacaacttactgatgatcaacgcgcacattgcgcacgattgtacggtaggtaaccgctgtattctcgccaacaacgcaacgctggcgggtcacgtatcggttgacgacttcgcgatcatcggcggcatgaccgcagtccatcagttctgcatcattggtgcgcacgtgatggttggcggctgctccggtgtggcgcaggacgtccctccttatgtcattgcgcagggtaaccacgcaacgccgttcggtgtcaatatcgaagggctgaagcgccgcggattcagccgtgaggcgattaccgctatccgcaatgcgtataagctgatttatcgtagcggtaaaacgctcgatgaagtgaaaccggaaattgctgaactggcggaaacatatccggaagtgaaagcctttaccgatttctttgcacgctcaacgcgcggtctgattcgttaa

SEQ ID NO: 228 - DNA, 1149 bp, Escherichia coli
  CDS (1)...(1149)
atgactgaacagcgtccattaacgattgccctggtcgccggagaaacctccggcgatatcctgggggccggtttaatccgcgctctgaaagaacatgtgcccaacgcccgctttgttggtgttgccgggccacgaatgcaggctgaaggctgcgaagcctggtacgaaatggaagaactggcggtgatgggcattgttgaagtgctcggtcgtctgcgtcgcttactgcatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtcagtctgggcgtggcgacagaaacgtgttttcaaaataggcagagccaccgatctggtgctcgcatttctgcctttcgaaaaagcgttttatgacaaatacaacgtaccgtgccgctttatcggtcataccatggctgatgccatgccattagatccagataaaaatgccgcccgtgatgtgctggggatccctcacgatgcccactgcctggcgttgctaccggggagccgtggtgcagaagttgaaatgcttagtgccgatttcctgaaaacggcccagcttttgcgccagacatatccggatctcgaaatcgtggtgccactggtgaatgccaaacgccgcgagcagtttgaacgcatcaaagctgaagtcgcgccagacctttcagttcatttgctggatgggatgggccgtgaggcgatggtcgccagcgatgcggcgctactggcgtcgggtacggcagccctggagtgtatgctggcgaaatgcccgatggtggtgggatatcgcatgaagccttttaccttctggttggcgaagcggctggtgaaaactgattatgtctcgctgccaaatctgctggcgggcagagagttagtcaaagaattattgcaggaagagtgtgagccgcaaaaactggctgcggcgctgttaccgctgttggcgaacgggaaaaccagccacgcgatgcacgataccttccgtgaactgcatcagcagatccgctgcaatgccgatgagcaggcggcacaagccgttctggagttagcacaatga

SEQ ID NO: 229 - DNA, 597 bp, Escherichia coli
  CDS (1)...(597)
atgatcgaatttgtttatccgcacacgcagctggttgcgggtgtggatgaagtcggacgcgggccgttagttggcgcggtcgtcaccgctgcggtgatccttgacccggcgcgcccgattgccgggctgaatgattccaaaaagctgagcgaaaaacgccgtctggcgctctatgaagagatcaaagagaaagcgttgagctggagtctgggccgcgcggaaccccacgaaatcgacgagctgaacattcttcatgcgaccatgctggcgatgcagcgtgccgtcgctgggctgcatattgcgccggaatatgtgttgattgatggtaaccgctgcccgaaattaccgatgcctgcgatggctgtggtgaaaggcgatagccgcgtaccggaaatcagtgccgcgtctatcctggcgaaagtgacgcgtgacgccgaaatggcggcgctggatattgttttcccgcaatatggttttgcccaacacaaagggtacccaaccgcttttcatctggaaaaactggctgaacacggcgcgaccgaacaccatcggcgcagctttgggcctgtcaaacgcgcactgggacttgcgtcctga

SEQ ID NO: 230 - DNA, 3483 bp, Escherichia coli
  CDS (1)...(3483)
atgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttccacgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgtccggggcgtttgaccgtcttgggccacatcgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaa

SEQ ID NO: 231 - DNA, 720 bp, Escherichia coli
  CDS (1)...(720)
gtgaatgtcaatttctttgtcacctgtattggtgacgccctgaaatcaagaatggcacgagactccgtgctgctactggaaaaactcggctgtcgcgtaaatttcccggagaaacagggatgctgcggtcagcctgcgatcaatagcggttatatcaaagaagcgattccagggatgaaaaatctgatcgccgcactggaggataacgacgatcccattatttcaccggctggctcttgcacctatgccgtaaaaagttacccgacgtatctggcggatgaacctgaatgggcatcacgtgccgcaaaggttgccgcgcgtatgcaggatctcacctcttttattgttaataaattaggggtagtcgatgtaggtgccagtttgcaagggagagcggtgtatcacccatcttgtagcctggcccgtaagctgggagtgaaggacgagccacttacgctgctgaaaaatgtgcgtggactggagctgttgacctttgctgaacaggatacctgctgcggatttggcggcacgttctcggtcaaaatggccgaaatatccggcgagatggtgaaagaaaaggttgcgcacctgatggaagtccgccctgagtatttaattggtgctgacgtgagttgcctgctaaacatcagtgggcgattacaacgggaagggcagaaagtcaaagtgatgcatattgctgaagtgttgatgagccgctga

SEQ ID NO: 232 - DNA, 1428 bp, Escherichia coli
  CDS (1)...(1428)
atgtcgatcaaaaccagtaatacagattttaagacacgcatccgtcagcaaattgaagatccgatcatgcgcaaagcggtggcaaacgcgcagcagcgtattggggcaaatcggcaaaaaatggtcgatgaattggggcactgggaggagtggcgcgatcgggccgcccagatacgtgatcatgttctgagtaatctcgacgcttatctgtaccagctctcagaaaaagtgacgcaaaacggcggtcacgtctattttgcaagaaccaaagaagacgctacccgctacattttacaggttgcccaacgcaaaaatgcccggaaggtggtgaaatctaaatcgatggtgaccgaagagattggtgtcaatcatgtgttgcaggatgctggcattcaggtgattgaaaccgatctgggtgaatatattctccagctggatcaagatccgccatctcatgttgtggtcccggcaattcataaagatcgccatcagatccgtcgagtgctacacgaacgtctgggctatgaggggccggaaacgcctgaagcgatgaccttattcatccggcaaaaaatccgcgaagatttcctcagtgctgaaataggtattaccggctgtaatttcgcggtggcagagaccggttcggtatgcctggtgaccaatgaaggtaatgcgcgaatgtgtaccacgctgcctaaaacgcatattgcagtgatgggaatggagcgtattgcccccacgtttgccgaggtagatgtattgatcaccatgctggcgcgcagtgccgttggtgcacgtttgacgggatacaacacctggctgacaggaccgcgcgaagctgggcacgttgatggtcctgaagagtttcatctggttattgtcgataacgggcgttctgaggtgctggcctctgaatttcgggatgtgctgcgctgtattcgctgcggggcttgtatgaatacttgtccggcatatcgccatattggcggtcatggatatggctctatttatccagggccaattggtgcggtgatttctccgctacttggcggctataaagattttaaagatttaccctacgcctgctctttatgcacagcttgtgacaacgtgtgtccggtgcgtattccgctgtcaaaactgattttgcgtcatcgtcgggtgatggctgaaaaagggatcaccgcaaaagcagagcaacgggcgataaaaatgttcgcttatgccaatagtcatccaggattgtggaaagtcgggatgatggccggtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataa

SEQ ID NO: 233 - DNA, 849 bp, Escherichia coli
  CDS (1)...(849)
gtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataatcgaggcgaatttttgaataacgttgctcaggcactgggtcgcccgctgcgacttgaaccgcaagcagaagatgcgccgcttaacaactatgctaacgagcggcttacccaacttaaccaacagcagcgctgtgacgcgtttattcagtttgccagcgatgttatgttgacgcgctgtgagctgaccagcgaggcgaaggcggcagaagctgcaatacgtctgtgtaaagagctgggagatcagtcggtcgtgattagcggtgacacgaggctggaggaattggggattagcgaacgtttgcagcaggaatgcaatgccgttgtttgggatccggcgaaaggtgccgagaatatctcgcaggcagagcaggctaaagtgggtgttgtgtatgctgaatatggtttaaccgaatcgggaggcgtggttcttttttccgccgccgagcgcgggcgttcattgagcctgctcccggaatattctctttttatcctgcgtaaaagcactatcctgccgcgtgtagcgcaactcgcagaaaaattgcatcagaaagcgcaggccggtgaacgaatgccttcctgcattaacatcattagcggccccagttcaacggcggatattgagcttatcaaagtcgtcggagttcatggcccggtgaaagcggtgtatctgattattgaggattgttga

SEQ ID NO: 234 - DNA, 1173 bp, Escherichia coli
  CDS (1)...(1173)
ttgagcgagatagcgatgcacgttacagccaagccctccagttttcaatgtaatctcaaatgtgattactgtttttaccttgaaaaagagtcgcagtttactcatgaaaaatggatggatgacagcactctgaaagagttcatcaaacaatatatcgcagcgtctggcaatcaggtctattttacctggcaaggcggtgaacccactctggctggcctggattttttccgtaaagttattcactatcaacaacgctatgcaggccaaaaacgtatttttaatgcattacaaacgaatggcattttattgaataatgaatggtgtgcctttctcaaagaacatgaatttctggttggtatctcgatcgatggcccccaggagttacatgaccgttacagacgcagtaattcaggtaacggtacttttgcaaaagtgatagcagccatcgagcgtctgaaatcatatcaagtagagtttaatacgttaaccgtcattaataacgttaatgtccattaccctcttgaggtttatcattttttaaaatctatcggcagtaaacatatgcaatttatcgaattgctagaaaccgggacgccgaatattgatttcagtggtcatagtgagaacacattccgtatcattgatttttctgtgcctcccacggcttatggcaagtttatgtcaaccatttttatgcaatgggttaaaaacgatgtgggtgaaattttcatccgtcagtttgaaagctttgtcagccgttttttggggaatgggcataccagttgtattttccaggagtcctgcaaggataatctggttgttgaaagtaatggagacatttacgaatgcgaccattttgtctatccacagtacaaaattggaaacattaataaatctgaactcaaaacgatgaacagtgtacaactgacagcgcaaaaaaaacggattccagcgaaatgtcagcaatgtgcatataaacctatctgcaatggcggttgtcctaagcatcgtattactaaagtaaacaatgagactgtttcttatttttgcgaaggttataaaatccttttttcaaccatggtaccttatatgaacgccatggtagagttagctaagaacagagtaccgctttaccacattatggatgttgcaaaacaaatggagaataattaa

SEQ ID NO: 235 - DNA, 1716 bp, Escherichia coli
  CDS (1)...(1716)
ttggaattaagtacaataagaagaggaacatttatgaagtctgcattaaagaaaagtgtcgtaagtacctcgatatctttgatactggcatctggtatggctgcatttgctgctcatgcggcagatgatgtaaagctgaaagcaaccaaaacaaacgttgctttctcagactttacgccgacagaatacagtaccaaaggaaagccaaatattatcgtactgaccatggatgatcttggttatggacaacttccttttgataagggatcttttgacccaaaaacaatggaaaatcgtgaagttgtcgatacctacaaaatagggatagataaagccattgaagctgcacaaaaatcaacgccgacgctcctttcattaatggatgaaggcgtacgttttactaacggctatgtggcacacggtgtttccggcccctcccgcgccgcaataatgaccggtcgagctcccgcccgctttggtgtctattccaataccgatgctcaggatggtattccgctaacagaaactttcttgcctgaattattccagaatcatggttattacactgcagcagtaggtaaatggcacttgtcaaaaatcagtaatgtgccggtaccggaagataaacaaacgcgtgactatcatgacaacttcaccacattttctgcggaagaatggcaacctcaaaaccgtggctttgattactttatgggattccacgctgcaggaacggcatattacaactccccttcactgttcaaaaatcgtgaacgtgtccccgcaaaaggttatatcagcgatcagttaaccgatgaggcaattggcgttgttgatcgtgccaaaacacttgaccagccttttatgctttacctggcttataatgctccgcacctgccaaatgataatcctgcaccggatcaatatcagaagcaatttaataccggtagtcaaacagcagataactactacgcttccgtttattctgttgatcagggtgtaaaacgcattctcgaacaactgaagaaaaacggacagtatgacaatacaattattctctttacctccgataatggtgcggttatcgatggtcctctgccgctgaacggggcgcaaaaaggctataagagtcagacctatcctggcggtactcacaccccaatgtttatgtggtggaaaggaaaacttcaacccggtaattatgacaagctgatttccgcaatggatttctacccgacagctcttgatgcagccgatatcagcattccaaaagaccttaagctggatggcgtttccttgctgccctggttgcaagataagaaacaaggcgagccacataaaaatctgacctggataacctcttattctcactggtttgacgaggaaaatattccattctgggataattaccacaaatttgttcgccatcagtcagacgattacccgcataaccccaacactgaggacttaagccaattctcttatacggtgagaaataacgattattcgcttgtctatacagtagaaaacaatcagttaggtctctacaaactgacggatctacagcaaaaagataaccttgccgccgccaatccgcaggtcgttaaagagatgcaaggcgtggtaagagagtttatcgacagcagccagccaccgcttagcgaggtaaatcaggagaagtttaacaatatcaagaaagcactaagcgaagcgaaataa

SEQ ID NO: 236 - DNA, 825 bp, Escherichia coli; identical to SEQ ID NO: 198
  CDS (1)...(825)

SEQ ID NO: 237 - DNA, 519 bp, Escherichia coli; identical to SEQ ID NO: 197
  CDS (1)...(519)

SEQ ID NO: 238 - DNA, 1704 bp, Escherichia coli
  CDS (1)...(1704)
atggcttttgtatcagaaagagaaattgtaagaaagatatttagcaaaaaaattgactttacgatcttggcatttttctatatttcctctattttttttcttctttgtagtggcgttctctttcaatattttaccgctgccttcacaaaaggtaattgttatgaatgctcaatgaaacttgattacataaaacaattttatttttcactggaaaccgcatggtacctcatatctgctgttgcagtatttattgcatctgtttttatacagcatagaattaaagcttatttaacattattagctattacatggattgtactaacaataacagatgtggcgttaatacacgccttagacaatatagccatgaataatattttgttaaatatactatataatctttttggggcgattttattgtcactgtttatgtgtttatcaaattccctccttttccaccttaataagataaaacatattccaatgattttatcggcaatgattccattagtttccgcaataataatagccatactcataaccgctgttatatatttattgtttgcccggcaggcggtagagattgagatggatatatctgaaggttcagacatcgcatatgtaggtgtaaaagataatgaggaatcatttgggtttttaaatgataaaaaaacagacacaccaacgtatctggatgtaatcaaaaatggtagtttgatatataatgatacacagggtttaagtggtgctgatatttatattgtctccggttgttatgcccttccagatttacttcgcaatgtaccgcttgatgctaaaaaatcttttctgaatgtaaaaaagctagaaatcacacagaaacttccaatgatggggttcatacaaggtgaatccgctgatgtgatgcctaaagcagcatccaggttaagtttgagcaagcaagatgataaatttatgctagcctcaagtgttactgactctcaaataaaatttaaatcaaacaatgcacaattgatggttgctttcgcatttatgccaataacaacgaatggtattttacatgattatacatacgatataataataaatgataaaaaatataaaattgaaaatcatgttgcacctctatctaggcttgataaaaataagaagatgaagtgtgaataccagcaaatatcggatttaacaaatacgtataacattaatgcaaattacttaacgggttttttacttgtcctaaaaccagatgatattattaattacaacaatagcccttccgtactactcaagactgattttgcgttctataaaaaaacataccagaagcttgataaaatatatgatgacataagcaatggaaaattatcttcactgagagcaacaggtatctcccagtttagtatcaacgggaaacatttgtcgttaaggccagaatcggagattattatttctgaagggagtttgtatggactagttaataaaagcaaaaaaatcaaaatatatggcacagcagatcttgtttttgttgataacaagataatgaaccttcgtaaaataacttatttgcaatctaagctagaaatttttggttcttctattatggatatattaaagtatatatttggtttaggtctgctagcaatttctataaaattcattcattcttactttaagaatgatgtgaatgaaaatttattcttgtaa

SEQ ID NO: 239 - DNA, 1092 bp, Escherichia coli
  CDS (1)...(1092)
atgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtga

SEQ ID NO: 240 - DNA, 366 bp, Escherichia coli
  CDS (1)...(366)
atgatgtccaccacgttatttaaagatttcaccttcgaagccgctcaccgcttaccacacgtcccggaagggcataaatgtggtcgcctgcacgggcattcctttatggtgcgactggaaattaccggggaagtcgatccgcatacgggctggattatcgatttcgctgaactaaaagcggcgtttaaaccaacctacgagcgcctcgatcaccattatctcaatgatattccaggtctggaaaacccaaccagcgaggttttagcaaaatggatttgggatcaggttaaacccgttgtgccgctgttaagtgcggtgatggtaaaagaaacctgcaccgcaggttgtatctatcgcggcgaatga

SEQ ID NO: 241 - DNA, 1302 bp, Escherichia coli
  CDS (1)...(1302)
gtgttgtgttctggatatctggggcatgacatggaagacgactgcgacattattattattggtgccggtattgcaggcaccgcttgcgcgttacgctgcgcgcgagcgggtttatccgttttgttactggaacgcgctgaaatccccggcagcaaaaatctttccggcgggcggttatatacccatgcactcgcggaactcctcccgcaatttcatctgaccgcgcctcttgaacgacgcatcactcacgaaagcctttccctgttaacgcccgatggcgtaacgacgttttccagcttacagcccggcggtgaatcctggagtgtattacgtgcacgattcgatccgtggctggttgccgaagccgaaaaagaaggtgtcgaatgcatccccggagcgacggtggatgcactgtatgaagaaaacggcagagtctgtggcgttatttgtggtgacgatattctccgcgcccgttatgtggtgctggcagaaggtgccaacagcgtcctggctgaacgtcacgggttagtgactcgtcctgctggcgaagcgatggcgttggggatcaaagaagtgctgtcgctggaaacatccgctattgaagaacgttttcatctggagaataacgaaggcgcagcgttgctgttcagcggcaggatctgtgatgacttacccggcggcgcatttctttatactaatcaacaaacgctctcgttagggattgtttgcccgctctcttcccttacgcaaagtcgtgttccggcaagcgagctgctgactcgctttaaagcgcatccggcagtgcgcccgcttatcaaaaacacggaatcactggagtatggtgcgcatctggtgccagaaggtggcttgcacagtatgccggtgcaatacgccggtaacggctggctgctggtgggcgatgcgttgcgcagttgcgtcaataccggaatttccgtgcgcggcatggatatggcgctgactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgcccgggatggtaccgtacgtggcctgcgttaatgcaggatatttcccgcgatttatgggatcagggtgataaacctgttccaccgctgcgccagttattctggcatcatttacgtcgtcacggcctgtggcatctggcgggcgatgttatcaggagtctgcgatgtctgtag

SEQ ID NO: 242 - DNA, 297 bp, Escherichia coli
  CDS (1)...(297)
gtggcatctggcgggcgatgttatcaggagtctgcgatgtctgtagcccgtaatctctggcgcgttgctgatgcgccgcacattgttccggctgactccgttgagcgccagacggcagaacggttgattaacgcctgtccggcaggtcttttttcgctcacaccggaaggtaacttacgtattgactatcgcagttgcctggagtgtggcacctgccgtttgctgtgcgacgaatcaacactacaacagtggcgctatccgccttccggattcggcatcacctaccgctttggataa

SEQ ID NO: 243 - DNA, 576 bp, Escherichia coli
  CDS (1)...(576)
atgcccctcttacacctgctccgccagaatccggtgattgctgccgttaaagataatgccagcctgcaactggcaatcgattctgaatgccaatttatttccgtgttgtacggcaatatctgcaccatcagtaatatcgttaaaaagattaagaacgccgggaaatatgcttttattcatgttgatttgctggaaggcgcgtcaaataaagaagtcgttattcagtttttgaaactggtgaccgaggcggacggcattatcagtaccaaagcctcaatgttgaaagcggcaagagcggaaggttttttctgtattcatcgcctgtttattgttgattcaatttcgtttcacaacattgataagcaagttgcgcaatcgaatccggattgtattgagatcctgccaggctgtatgcccaaagtgctgggctgggtgacagagaaaatccgccaaccgctgattgccggtgggctggtgtgcgatgaagaagatgcgcgtaatgcgattaacgcgggtgtcgtggcgctttccaccacgaataccggggtctggacgttagcgaaaaaattactttga

SEQ ID NO: 244 - DNA, 405 bp, Escherichia coli
  CDS (1)...(405)
atgttcatgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcaaaaagctccagcagcctgctgccggaactgtctgctgaagcaaacccgttccgtaatcgtctggcagagtctgaagccagcaacgatcaggcaccggtgcagatgcctcgcgactattctgaaggcgcatccggcctgctgcgtactggcgcgaagcgcgactaa

SEQ ID NO: 245 - DNA, 1368 bp, Escherichia coli
  CDS (1)...(1368)
atgaaaaaacaaacccagctgttgagtgcattagcgttaagtgtcgggttaactctctcggcgtcatttcaggccgtcgcgtcgattccaggccaggttgccgatcaggcccctctccccagtctggctccaatgctggaaaaagtgcttccggcagtggtgagcgtacgggtggaaggaacggccagtcagggacagaaaatcccggaagaattcaaaaagttttttggtgatgatttaccggatcaacctgcacaacccttcgaaggtttaggctccggtgtcatcatcaacgccagtaaaggctatgtgctgaccaacaaccatgtgattaatcaggcacagaaaatcagtattcagctcaatgatgggcgcgagtttgatgcaaaactgattggtagcgatgaccagagcgatatcgccctgttacaaattcaaaacccgagcaaattaacgcaaatcgctattgccgactccgataaattgcgcgtcggtgattttgccgtagcggtcggtaacccatttggccttgggcaaaccgccacctctggcattgtttccgcattaggccgcagcgggttgaatcttgaaggtctggaaaactttatccagacagatgcttccattaaccgcggtaactccggcggtgcactattaaaccttaacggtgagttaattggcatcaacactgcaatccttgcgcctggcggcgggagcgtcgggattggatttgccatccccagtaatatggcgcgaacactggcgcagcagcttatcgactttggtgaaatcaaacgcggtttgttaggcatcaaaggcaccgagatgagtgccgatatcgccaaagccttcaaccttgacgtgcagcgtggcgcgtttgtcagcgaagtgttgccaggttctggctcggcaaaagcgggcgtcaaagcgggcgatattattaccagcctcaacggcaaaccgctgaatagctttgctgagttgcgctctcgtatcgcgaccaccgagccgggcacgaaagtgaagcttggcctgctgcgtaacggcaaaccactggaagtagaagtgacgctcgataccagcacctcttcgtcggccagcgctgaaatgatcacgccagcgctggaaggtgcaacgttgagcgatggtcagctaaaagatggcggcaaaggtattaaaatcgatgaagttgtcaaaggaagcccagctgctcaggctggcttgcaaaaagacgatgtgatcattggcgtcaaccgcgatcgggtgaactcgattgctgaaatgcgtaaagtgctggcggcaaaaccggccatcatcgccctgcaaattgtacgcggcaatgaaagcatctatctgctgatgcgttaa

SEQ ID NO: 246 - DNA, 1068 bp, Escherichia coli
  CDS (1)...(1068)
atgtttgtgaagctcttacgttccgttgcgattggattaattgtcggcgctattctgctggttgccatgccttcgctgcgcagccttaacccgctttccactccgcaatttgacagtaccgatgagacgcctgccagctataatctggcggttcgccgcgccgcgccagcggtggttaacgtttacaaccgtggtttgaacaccaactctcacaaccagcttgagatccgcaccctgggatccggtgtaatcatggatcaacgcggttatatcatcaccaataaacacgtcatcaacgacgccgatcagatcatcgtcgccttacaggatggacgtgtatttgaagcattgctggtgggatctgactctctaaccgatctggcggtacttaaaattaatgccactggcggtttacctaccattccaattaatgcacgtcgcgtaccgcacattggcgacgtagtactggcgatcggtaacccgtacaacctcgggcagaccattacccaggggattattagtgccacgggtcgaatcggtctgaacccgaccgggcggcaaaacttcctccaaaccgatgcttccattaaccacggtaactctggcggcgcgctggtgaactcgctgggcgaactgatgggcattaatacgctgtcgtttgataagagtaacgatggcgaaacgccggaaggtatcggctttgcgattcctttccagttagcaaccaaaattatggataagctgatccgcgatggtcgcgtgatccgcggctacattggtatcggcggacgtgagatcgcaccactgcacgcgcagggcggtggtatagatcaactgcaagggatcgtggttaatgaagtgtcacctgacggcccggcggcgaatgcgggtattcaggtcaacgatctgattatttcggtggataacaaaccggccatctctgctctggagacgatggatcaggtggcggaaattcgccctggttcggtgatccctgtagtagtgatgcgtgatgataagcagttaacgctgcaggtcaccattcaggaatatccggcaaccaattaa

SEQ ID NO: 247 - DNA, 357 bp, Escherichia coli; identical to SEQ ID NO: 215
  CDS (1)...(357)

SEQ ID NO: 248 - DNA, 390 bp, Escherichia coli; identical to SEQ ID NO: 216
  CDS (1)...(390)

SEQ ID NO: 249 - DNA, 621 bp, Escherichia coli; identical to SEQ ID NO: 217
  CDS (1)...(621)

SEQ ID NO: 250 - DNA, 990 bp, Escherichia coli; identical to SEQ ID NO: 218
  CDS (1)...(990)

SEQ ID NO: 251 - DNA, 384 bp, Escherichia coli; identical to SEQ ID NO: 219
  CDS (1)...(384)

SEQ ID NO: 252 - DNA, 141 bp, Escherichia coli
  CDS (1)...(141)
atgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttctaagtaa

SEQ ID NO: 253 - DNA, 360 bp, Escherichia coli
  CDS (1)...(360)
gtggttaagctcgcatttcccagggagttacgcttgttaactcccagtcaattcacattcgtcttccagcagccacaacgggctggcacgccgcaaattaccattctcggccgcctgaattcgctggggcatccccgtatcggtcttacagtcgccaagaaaaacgttcgacgcgcccatgaacgcaatcggattaaacgtctgacgcgtgaaagcttccgtctgcgccaacatgaactcccggctatggatttcgtggtggtggcgaaaaaaggggttgccgacctcgataaccgtgctctctcggaagcgttggaaaaattatggcgccgccactgtcgcctggctcgcgggtcctga

SEQ ID NO: 254 - DNA, 1776 bp, Escherichia coli
  CDS (1)...(1776)
gtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtaccaggcgattgttgaccacgttcctgcgccggacgttgaccttgacggtccgttccagatgcagatttctcagctcgattacaacagctatgttggcgttatcggcattggccgcatcaagcgcggtaaagtgaagccgaaccagcaggtcactatcatcgatagcgaaggcaaaacccgcaacgcgaaagtcggtaaagtgctgggccacctcggtctggaacgtatcgaaaccgatctggcggaagctggcgatatcgttgcgatcacgggccttggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctgcgcgtagaagaaaccgaagacgccgatgcgttccgcgtttctggtcgtggcgaactgcacctgtctgttctgatcgaaaacatgcgtcgtgaaggtttcgaactggcggtatcccgtccgaaagttatcttccgtgaaatcgacggtcgtaaacaagagccgtatgaaaacgtgactctggacgttgaagaacagcatcagggttctgtaatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtactggtctgctgtactccaccttcagccactacgacgacgtacgtccgggtgaagtgggtcagcgtcagaacggcgtactgatctctaacggtcagggtaaagcggtcgcgttcgcgctgttcggtctgcaggatcgcggtaagctgttcctcggtcacggtgcagaagtttacgaaggtcagattatcggtattcatagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgaactggtagaagtgactccgacctctatccgtattcgtaaacgtcactga

SEQ ID NO: 255 - DNA, 2271 bp, Escherichia coli
  CDS (1)...(2271)
atgatgaaagtattaattgttgaaagcgagtttctccatcaagacacctgggtcggtaacgccgttgagcgtctggcagatgctttaagccagcaaaatgttaccgtgattaaatccacctcctttgatgatggttttgccattctctcttcaaacgaagccattgactgcctgatgttcagctatcaaatggaacatccggacgaacatcaaaacgtcagacaattgatcggtaagcttcatgagcgccaacaaaacgtgccggtcttcctgttgggcgatcgggaaaaagccctcgccgcaatggatcgcgacctgctggagcttgtcgatgaattcgcctggattctggaagataccgccgactttatcgccggacgcgccgttgccgcgatgacccgctaccgccagcagctgttgccgccactgttcagcgcgctgatgaaatatagtgacatccatgaatattcctgggcagcgccaggccaccagggcggcgttggttttaccaaaacacccgccggacgtttctaccatgactactatggtgaaaatctgttccgcaccgacatgggcatcgaacgaacttccctcggttctttgcttgaccatactggcgcatttggcgaaagcgaaaaatatgccgcacgcgtatttggtgccgatcgctcctggtcggtagtcgtcggtacttccggctctaaccgcaccatcatgcaggcttgcatgaccgataacgatgtcgtggtcgttgaccgtaactgccataaatccatcgaacaaggtttgatgctgacaggcgcgaaaccggtctatatggtgccaagccgcaaccgctacggcattatcgggccaatctatccgcaggaaatgcaacctgaaaccttgcagaagaaaatcagtgaaagcccgctgaccaaagacaaagccgggcaaaaaccgtcttactgcgtggtgaccaactgcacctatgacggcgtgtgttataacgctaaagaagcgcaggatctgctggaaaaaacctccgatcgtctgcactttgacgaagcctggtacggctatgcacgtttcaacccgatctatgccgatcactatgccatgcgcggcgaacctggcgatcacaacggtcctaccgttttcgccacccactccacccacaaactgctgaatgcgctgtcacaggcttcttatattcatgtacgtgaaggtcgtggggcgattaacttctcccgcttcaaccaggcctacatgatgcatgccaccacctccccgctgtatgccatctgcgcatccaacgacgtggcggtgtcgatgatggacggcaacagcggcctgtcactgacacaggaagtgattgacgaagcggttgatttccgtcaggcgatggcgcggctatataaagagttcaccgctgacggtagctggttcttcaaaccgtggaacaaagaagtcgtcaccgacccacaaaccggcaaaacctatgactttgctgacgcaccaaccaaactgctgaccaccgttcaggactgctgggtaatgcatccgggcgaaagctggcacggcttcaaagatattccggataactggagtatgctcgacccgattaaagtcagcatccttgctccgggaatgggtgaagatggtgaactggaagaaaccggtgttccggcggcgctggtcactgcctggcttggtcgccacggcattgtacctacccgcaccactgacttccaaattatgttcctgttctctatgggcgtaacccgtgggaaatggggaactctggttaacaccctttgctccttcaaacgccactatgacgccaacacaccgctggcgcaggtgatgccggaacttgttgaacaatatcctgacacttacgcgaacatggggattcacgatctgggtgacaccatgtttgcctggctgaaagaaaacaaccctggcgcacggttgaacgaagcctattccggcctgccggtggcggaagtcaccccgcgtgaagcgtacaacgcgattgtcgacaacaatgtcgaactggtatccattgaaaatctgccaggacgcatcgcggcaaactcagttatcccgtatccgccaggaatcccgatgctgctgtctggtgaaaacttcggcgataaaaacagtccgcaagtaagttatttacgctcgctgcaatcctgggaccaccatttccctggatttgaacacgaaactgaagggactgaaattattgacggtatttaccacgttatgtgcgtgaaagcgtaa

SEQ ID NO: 256 - DNA, 762 bp, Escherichia coli
  CDS (1)...(762)
atgaggatttgcagcgaccaaccttgtattgttttattgactgaaaaagatgtctggataagggtgaatgggaaagaacctattagccttaaagctaaccatatggcgttattaaattgtgaaaataatattatcgacgtctcctctcttaacaacactttggttgctcatattagtcacgacatcatcaaagattacctccggtttctgaataaagatctctcgcaaataccagtatggcaacgtagcgctacgcccatactcaccctgccatgcctgacgccagacgtctttcgcgttgccgcgcaacacagcatgatgcccgcagaaactgagtcagaaaaggaacgaacacgcgcattattattcacggtgctatcccgttttctcgacagtaaaaaattcgtttcattaatgatgtatatgttacgtaattgtgtaagtgacagcgtttatcaaattattgaaagcgatattcacaaagactggaatcttagtatggtagccagttgtttatgtcttagcccaagtctgttaaagaaaaagttgaaaagcgaaaacaccagttatagccaaataatcaccacctgccgcatgcgttatgccgtaaatgaattaatgatggacggtaaaaatatctctcaggtatcacagtcctgcggctacaacagtacgtcgtactttatttctgtctttaaagacttctacggtatgacgccgctgcattatgttagtcagcacagagaacgcactgtcgcctga

SEQ ID NO: 257 - DNA, 1278 bp, Escherichia coli
  CDS (1)...(1278)
ttgttgaggctccctaatatttactttaagggctatattagaataacacaggaaacaaatatggcaacagcatggtataaacaagttaatccaccacaacggaaagctcttttttccgcatggcttggatatgtatttgatggctttgattttatgatgatattttacattcttcatattataaaagcagatcttggcattacggatattcaggctactttaatagggacagtggccttcatagccagacctattggaggtggtttttttggtgccatggctgataaatatggtcgtaagccaatgatgatgtgggcaattttcatttactcagtcggaacaggccttagcggtattgctacaaacttatatatgctcgcagtttgccgttttattgttggcttagggatgtctggtgaatatgcatgtgcttcaacttatgcggtagaaagttggcctaaaaatcttcaatctaaagctagtgcttttttggtaagtggtttttctgttggaaatattattgcggcacaaataatccctcagtttgctgaagtatatggatggagaaactctttttttataggcctgttaccagttttactagttctttggatcagaaaaagtgctccagaaagtcaggagtggattgaagataaatataaggataaatcaacatttttgtctgtcttcagaaaaccacatctttcaatctctatgatcgttttcctcgtctgtttttgtctatttggtgcaaactggccgataaacggactacttccttcctacctggcagataatggagttaatacagtggtcatttcaactctgatgacaatagcaggtttaggaacactgacaggtacaatattttttggttttgttggtgataagattggtgtaaaaaaagcctttgtagtcggtctaataacttcatttattttcctttgtcctcttttttttatttctgtgaaaaactcttctcttataggattatgtctctttggattaatgtttacaaatttaggtattgcagggttggttccaaaatttatatatgattactttccaacaaaattaagaggattagggaccggtcttatttataacttaggggcaactggaggaatggccgcacctgtattagctacatacatttcaggatattatggcttaggtgtttcattattcattgttacggttgcattctctgccttattaattttgttagttggttttgatattccaggtaaaatttataaactatccgtggctaaatga

SEQ ID NO: 258 - DNA, 1134 bp, Escherichia coli
  CDS (1)...(1134)
atgattggaggctttatgattaattatggcgttgttggtgttggatactttggcgctgaattagctcgttttatgaatatgcatgataatgcaaaaattacatgtgtatacgatcctgaaaatggagaaaatattgcccgtgaattgcagtgtatcaatatgtcaagcttggatgctttagtctcaagtaaattagtcgattgcgtgatcgtagccaccccaaattatctgcataaagaaccagtaattaaagcagcaaagaataagaagcatgttttttgtgaaaaaccaattgcattaagttatgaagattgtgtggatatggtcaaagcgtgtaaagaagctggtgtgacctttatggccgggcatattatgaattttttcaatggggttcaatatgcacggaagttaattaaagaaggtgttatcggcgaaatattatcatgtcatactaagagaaatggctgggaaaacaaacaagagagactttcctggaaaaagatgaaagaacaatctggtggacatctatatcatcatatacatgagttagattgtgttcagcatttacttggagaaataccagagacggttactatgattggtggaaatttggcccattctggtccaggatttggcaatgaagatgatatgttatttatgaccttggaattcccgtcaggaaaactagcaaccttagagtgggggagtgcatttaactggccggaacattatgtcatcatcaatggaactaaaggctctattaaaattgatatgcaagaaacagcagggtcacttaggattggcggtcagacaaagcattttttggtccatgaaacacaagaagaagatgatgatcgtcggaaaggcaatatgacctcagaaatggatggcgctatagcatatggtcatccaggaaaaaaaacaccattatggcttgccagtttaataagaaaggagacgttattcctccataatatcctctgtggtgcaaaacctgaagaagattatattgaccttctcaatggtgaggcggccatgtcggcgattgctactgctgatgctgccactctttcaagatcgcaggacaggaaagtgaaaatcagtgagatcattaaacatacatcagtaatgtaa

SEQ ID NO: 259 - DNA, 1395 bp, Escherichia coli
  CDS (1)...(1395)
atgagtgcggggaaattgccggaggggtgggttatcgccccagtatctacggtcacaactctaatccgaggagtaacgtataaaaaagagcaggcaataaattatctaaaagatgattatttgcctcttatccgtgcgaacaatattcagaatggcaagtttgatactacggacttggtttttgttcctaaaaatcttgttaaagaaagtcaaaaaatatctcctgaagatattgttattgcaatgtcatcagggagcaaatccgtagttggtaaatccgcacatcagcatctaccatttgaatgtagtttcggcgcattttgcggtgtattacgtcctgaaaaacttatattttctggttttattgctcatttcacaaaatcttctctttatcgaaacaaaatttcatcactttctgctggtgcaaatattaataatattaagccggcaagctttgatttgataaatataccaatcccaccacttgccgaacaaaaaatcatcgctgaaaaactcgatacgctgctggcgcaggtagacagcaccaaagcacgttttgagcaaatcccacaaatcctgaaacgttttcgtcaagcggtattggggggcgcagttaatggaaaattgacagaaaaatggcgtaattttgagccgcaacattctgtatttaagaagttaaattttgaatctatcttaactgaattacgtaatggtctttcatcaaagccaaatgaaagtggtgttggtcatccaatactacgcattagttctgtacgtgctggccatgtagatcaaaacgatattcggtttctagaatgttcagaaagtgaactaaaccgccacaaattacaagatggagatcttttatttactcgctataacggaagtttagaatttgttggtgtttgtgggttattgaaaaaattacaacatcaaaatttgctatatcctgataaacttattcgagctcgattaaccaaagatgctttaccagaatatatcgaaatatttttttcatccccctcagcacgaaatgcaatgatgaactgcgtgaaaacaacttctggtcaaaaaggtatttcaggaaaagatatcaaatcccaagttgttttattacctccagtaaaagaacaagccgaaatcgttcgccgcgtcgagcaactcttcgcctacgccgacaccatagaaaaacaggtcaacaacgccttagcccgcgtcaacaacctgacgcaatccatcctggcaaaagcgttccgtggtgaacttaccgcccagtggcgggccgaaaacccggatttgatcagcggagaaaacagcgccgccgcgttgctggaaaaaatcaaagctgaacgcgcagctagcgggggtaaaaaagcctcacgtaaaaaatcctga

SEQ ID NO: 260 - DNA, 1590 bp, Escherichia coli
  CDS (1)...(1590)
atgaacaataacgatctggtcgcgaagctgtggaagctgtgcgacaacctgcgcgatggcggcgtttcctatcaaaactacgtcaatgaactcgcctcgctgctgtttttgaaaatgtgtaaagagaccggtcaggaagcggaatacctgccggaaggttaccgctgggatgacctgaaatcccgcatcggccaggagcagttgcagttctaccgaaaaatgctcgtgcatttaggcgaagatgacaaaaagctggtacaggcagtttttcataatgttagtaccaccatcaccgagccgaaacaaataaccgcactggtcagcaatatggattcgctggactggtacaacggcgcgcacggtaagtcgcgcgatgacttcggcgatatgtacgaagggctgttgcagaagaacgcgaatgaaaccaagtctggtgcaggccagtacttcaccccgcgtccgctgattaaaaccattattcatctgctgaaaccgcagccgcgtgaagtggtgcaggacccggcggcaggtacggcgggctttttgattgaagccgaccgctatgttaagtcgcaaaccaatgatctggacgaccttgatggcgacacgcaggatttccagatccaccgcgcgtttatcggcctcgaactggtgcccggcacccgtcgtctggcactgatgaactgcctgctgcacgatattgaaggcaacctcgaccacggcggcgcaatccgtctgggcaacactctgggtagcgacggtgaaaacctgccgaaggcgcatattgtcgccactaacccgccgtttggcagcgccgcaggcaccaacattacccgcacctttgttcacccgaccagcaacaaacagttgtgctttatgcagcatattatcgaaacgctgcatcccggcggtcgtgcggcggtggtggtgccggataacgtgctgtttgaaggcggcaaaggcaccgacattcgtcgtgacctgatggataagtgtcatctgcacaccattctgcgtctgccgaccggtattttttacgctcagggcgtgaagaccaacgtgctgttctttaccaaagggacggtggcgaacccgaatcaggataagaactgtaccgatgatgtgtgggtgtatgacctgcgtaccaatatgccgagtttcggcaagcgcacaccgtttaccgacgagcatttgcagccgtttgagcgcgtgtatggcgaagacccgcacggtttaagcccgcgcactgaaggtgaatggagttttaacgccgaagagacggaagttgccgacagcgaagagaacaaaaacaccgaccagcatcttgctaccagccgctggcgcaagttcagccgtgagtggatccgcaccgcaaaatccgattcgctggatatctcctggctgaaagataaagacagtattgatgccgacagcctgccggagccggatgtattagcggcagaagcgatgggcgaactggtacaggcgctgtctgaactggatgcgctgatgcgtgaactgggggcgagcgatgaggccgatttgcagcgtcagttgctggaagaagcgtttggtggggtgaaggaatga

SEQ ID NO: 261 - DNA, 297 bp, Escherichia coli
  CDS (1)...(297)
atgaaaaaagagaactattcattcaagcaagcttgtgctgttgtcggtgggcaatcagcaatggctaggcttttaggtgtatcacctccaagcgtaaatcaatggatcaaaggggtacgtcaattgcctgccgagagatgtccagcaattgaacgtgcaacaagaggtgaggttctgtgcgaagaacttcgtcctgatattgactggtcatatttacgacgttcggcatgttgttcgcagaatatgtcagtgaagcaactaaatgacagtaacaaatcctcatttgatcatacctga

SEQ ID NO: 262 - DNA, 423 bp, Escherichia coli
  CDS (1)...(423)
atgaaaatcaagcatgagcacatcgaatcagtgttgtttgccctagcagccgaaaaagggcaggcatgggtagccaatgcaattactgaagaatatctgcgccaggggggcggcgaattgcccctggttccaggcaaggactggaacaatcagcagaatatctatcaccgttggttgaaaggtgaaacgaaaacgcaaagagaaaaaattcagaagctgatcccagcaattctggcaatccttccgcgcgagctgcgtcaccgactctgcatcttcgataccctggaacgccgtgcattactggcggcgcaggaagcgttaagtacggcaattgatgcgcatgatgatgcagtccaagccgtttaccggaaagcgcatttcagcggcggcggttcttccgacgattctgtcattgttcattaa

SEQ ID NO: 263 - DNA, 858 bp, Escherichia coli
  CDS (1)...(858)
atgctgtttgtgcttattctaagccaccgggcagcatcatacggggcaattatggccgcattaccatacatgcaactgtacatagctgattacctggctgacaccatgcatttgtcagcagaggagcatggtgcgtatttgttgctgatgttcaattactggcaaacaggaaagccaatacctaaaaacaggctggcaaaaattgcccgtctgactaacgagcgatgggctgatgttgaaccatccttgcaggagtttttttgcgataacggcgaggaatgggtgcatcttcggattgaggaagatctggcatcagtcagggaaaaattaaccaaaaaatcagccgcaggaaaagcatctgttcaggccagaagaagcagaaaggaagcagatgttcaaacaaaacaagagagaaatttaacaggtgttcaaacagatgttgaagtggtgtttgaacatgatgtcaacacaaaggcaactaataaagatacagataaagatctaaaaacagatccccccctaaatcccccccgggggaatcgaggtgtcaaaaagtttgaccctctggatattactttgccgaactggatttctgtctcgctttggcgtgagtgggttgaatttcgccaggcattgcgaaaaccgattcgaacggagcagggcgctaacggggcgatacgggagctggaaaaattccgccagcagggtttttcacctgagcaggtgattcgacacagcatcgccaatgaataccagggcttgttcgcgccgaaaggtgttcgacctgagacgttactccgacaggttaacaccgtctcgttaccggatagtgcgatcccgccaggcttcagggggtaa

SEQ ID NO: 264 - DNA, 747 bp, Escherichia coli
  CDS (1)...(747)
atgaaaaatattgcgacaggcgatgttcttgaacgtatccgcagactggccccgtcacatgtaaccgcgccattcaagacggtagcggagtggcgcgagtggcaactttccgaaggccagaaacgttgtgaggagatcaaccgtcagaatcgtcagttgcgggtggaaaaaattctgaatcgctctggcatccagccattgcaccgcaaatgctcgttttcgaattaccaggtgcagaacgaagggcagcgatacgcgttgagtcaggcgaaatccatcgctgatgaactgatgaccgggtgtacaaattttgcgttcagcggaaaacctggtaccgggaagaaccacttagcggcagctatcgggaatcgcctgctgaaagacggtcagacagtgattgtggttaccgtggctgatgttatgagtgccctgcacgccagctatgacgatgggcagtcaggcgaaaaatttttgcgggaactgtgcgaagtggatctgctggttcttgatgaaattggcattcagcgcgagacgaaaaacgagcaggtggtactgcaccagattgttgatcgccggacagcgtcgatgcgcagcgtggggatgctgacaaacctgaactatgaggccatgaaaacattgctcggcgagcggattatggatcgcatgaccatgaacggcgggcgatgggtgaattttaactgggagagctggcgtccgaatgtcgtccagccaggaattgcgaagtaa

SEQ ID NO: 265 - DNA, 612 bp, Escherichia coli
  CDS (1)...(612)
atgtcgtccagccaggaattgcgaagtaatttttaccgggagaaaaatttaatggagactgtttttgacgcactgaaagcaatgggaaaagccacatccatagaacttgctgcgcgacttgatatcagtcgtgaagaagtgctgaacgaactatgggaactgaaaaaggctggttttgttgataaaagcgcgtacacctggcgtgtggctgataacaatgttcagcaggaacagccagcgcaggcagaactgccggaagaaatcaccacagcaacagtagcgaaaatctcagagtgcgatttaaccgcgacgattgaacaacgaggaccacaaacggctgatgagctggctacattgtttggtaccacatcacgcaaagtggcttcaacgctggcaatggcaatcagcaaaggtcgtctgattcgcgtaaatcagggcggtaaatttcgttactgcataccgggcgataatttaccagcagagccgaaagcagcatcggtatctccgctctggttatctgcatcgtcgtctgcctgtcatggggtgttaatcattaccgtgataacgccatcgcctacaaagaacagcgcgacaaaaatgccagagaactga

SEQ ID NO: 266 - DNA, 306 bp, Escherichia coli
  CDS (1)...(306)
atgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctccgggaacgactggtaatgatgcaggcccaacttgaaggtgctcagcaatacataaccgagcagtgtttaaagtaa

SEQ ID NO: 267 - DNA, 879 bp, Escherichia coli
  CDS (1)...(879)
atgaaactgggatttattggcttaggcattatgggtacaccgatggccattaatctggcgcgtgccggtcatcaattacatgtcacgaccattggaccggttgctgatgaattactgtcactgggtgccgtcagtgttgaaactgctcgccaggtaacggaagcatcggacatcatttttattatggtgccggacacacctcaggttgaagaagttctgttcggtgaaaatggttgtaccaaagcctcgctgaagggcaaaaccattgttgatatgagctccatttccccgattgaaactaagcgtttcgctcgtcaggtgaatgaactgggcggcgattatctcgatgcgccagtctccggcggtgaaatcggtgcgcgtgaagggacgttgtcgattatggttggcggtgatgaagcggtatttgaacgtgttaaaccgctgtttgaactgctcggtaaaaatatcaccctcgtgggcggtaacggcgatggtcaaacctgcaaagtggcaaatcagattatcgtggcgctcaatattgaagcggtttctgaagccctgctatttgcttcaaaagccggtgcggacccggtacgtgtgcgccaggcgctgatgggcggctttgcttcctcacgtattctggaagttcatggcgagcgtatgattaaacgcacctttaatccgggcttcaaaatcgctctgcaccagaaagatctcaacctggcactgcaaagtgcgaaagcacttgcgctgaacctgccaaacactgcgacctgccaggagttatttaatacctgtgcggcaaacggtggcagccagttggatcactctgcgttagtgcaggcgctggaattaatggctaaccataaactggcctga

SEQ ID NO: 268 - DNA, 279 bp, Escherichia coli
  CDS (1)...(279)
atgaatcggccagcaatattaaaaaagaaagcagccaaagatgttgcttcagtattaaaaataatatttttattttatttgttcctcatagctagattaaaacaacgttattcgatacgtgaaattaagagggatttatggaacatcagagaaaactattccagcaacgcggctatagcgaagatctattgccgaaaacgcaaagccagcggacctggaaaacatttaactattttaccttatggatgggttcggttcataacgttcccaattatgtga

SEQ ID NO: 269 - DNA, 1314 bp, Escherichia coli
  CDS (1)...(1314)
atggtcggcggcttttttattctcggcttgtctacctttagtattatgctggcaattatcctcagcgcctttttcattgccgcggtaatggtattaaacggtgctgcgggcagtaaatacggtgtgccttttgccatgatcctgcgtgcttcttacggtgtacgtggtgcactgtttcccggattattaaggggcggaattgccgccatcatgtggtttggtttgcaatgttacgcggggtcactggcctgcttgattctgattggcaaaatctggccgggatttttaactctcggtggtgatttcactctgttaggcctttctctaccgggcttaattactttcttaatcttctggctggtcaacgttggtataggttttggcggtggcaaagttttaaataaattcactgccattcttaacccgtgcatctatatcgttttcggcggtatggcgatttgggcgatttcactggtcgggatcggtccaatctttgactacattccgagcggtattcagaaagcagaaaacggtggcttcctgttcctggtggtgattaacgcggtagttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcactacggcgctgatacctggaacgtgctggatattgttcagcgttgggacagcctgttcgcctcgttctttgcggtactggttattctgatgacaactatctccactaacgcgaccggtaatattattccagccggttatcagattgccgccattgcaccgacaaaactgacctataaaaacggcgtactgattgccagtattatcagcttgctgatctgcccgtggaaattaatggaaaatcaggacagcatttatcttttcctcgatattatcggcggaatgcttggtccggtaattggtgtcatgatggcgcattattttgtggtgatgcgcggacaaattaatcttgatgaactgtataccgcacctggcgattataaatattacgataacggttttaacctcactgcgttttcagtaactctggtggccgttattttatctcttggcggtaagtttattcactttatggaaccgttatcgcgtgtttcatggtttgtcggcgtcatcgtcgcctttgcggcctacgccttattaaagaaacgtacaacagcagaaaaaacaggagagcaaaaaaccataggttaa

SEQ ID NO: 270 - DNA, 1395 bp, Escherichia coli
  CDS (1)...(1395)
gtgttattactggatgcgtgctcgcaaatgtgcccgtcattcagacgattccagacagtgtttcataattcctccatttttctcccttattggctggctacactagtatcattccgcgaaacgtttcaggaagagaaactcttaacgatgaaaggtagttataaatcccgttgggtaatcgtaatcgtggtggttatcgccgccatcgccgcattctggttctggcaaggccgcaatgactcccggagtgcagccccaggggcgacgaaacaagcgcagcaatcgccagcgggtggtcgacgtggtatgcgttccggcccattagccccggttcaggcggcgaccgccgtagaacaggcagttccgcgttacctcaccgggcttggcaccattaccgccgctaataccgttacggtgcgcagccgcgtggacggccaactgatagcgttacatttccaggaaggccagcaggtcaaagcaggcgatttactggcagaaattgaccccagccagttcaaagttgcattagcacaagcccagggccaactggcaaaagataaagccacgcttgccaacgcccgccgtgacctggcgcgttatcaacaactggcaaaaaccaatctcgtttcccgccaggagctggatgcccaacaggcgctggtcagtgaaaccgaaggcaccattaaggctgatgaagcaagcgttgccagcgcgcagctgcaactcgactggagccggattaccgcaccagtcgatggtcgcgttggtctcaagcaggttgatgttggtaaccaaatctccagtggtgataccaccgggatcgtggtgatcacccagacgcatcctatcgatttagtctttaccctgccggaaagcgatatcgctaccgtagtgcaggcgcagaaagccggaaaaccgctggtggtagaagcctgggatcgcaccaactcgaagaaattaagtgaaggcacgctgttaagtctagataaccaaatcgatgccactaccggtacgattaaagtgaaagcacgctttaataatcaggatgatgcgctgtttcccaatcagtttgttaacgcgcgcatgttagtcgacaccgaacaaaacgccgtagtgatcccaacagccgccctgcaaatgggcaatgaaggccattttgtctgggtgctgaatagcgaaaacaaggtcagcaaacatctggtgacgccgggcattcaggacagtcagaaagtggtgatccgtgcaggtatttctgcgggcgatcgcgtggtgacagacggcattgatcgcctgaccgaaggggcgaaagtggaagtggtggaagcccagagcgccactactccggaagagaaagccaccagccgcgaatacgcgaaaaaaggagcacgctcctga

SEQ ID NO: 271 - DNA, 3123 bp, Escherichia coli
  CDS (1)...(3123)
atgcaggtgttacccccgagcagcacaggcggcccgtcgcgcctgtttattatgcgtcctgtggccaccacgctgctgatggtggcgatcttactcgccgggattatcggttatcgcgccctgcccgtttcggcgctgccggaagtggactatccgaccattcaggtggtcacgctctacccaggtgccagcccggatgtcatgacctctgccgttaccgcgccgctagaacgccagttcgggcagatgtctggcctgaaacagatgtcgtcgcaaagttccggcggtgcgtcagttatcactttgcagttccagctaacattaccgctcgatgtcgccgagcaggaagtgcaggccgcgattaacgctgcgaccaacttgttgccgagcgatctgcctaacccgccggtttacagcaaagtgaacccggcagatccgccgatcatgacgctcgccgtcacctcaaccgccatgccgatgacgcaagtggaagatatggtggaaacccgcgtcgcgcagaaaatctcgcagatttccggcgtcggcctggtgacgctttccggcggtcagcgtccggctgttcgcgtcaaacttaacgctcaggcgattgccgccctcggcctgaccagcgaaaccgtgcgcaccgccattaccggcgctaacgttaactcggcaaaaggtagcctcgacggcccttcccgtgcggtcacgctttccgcgaacgaccagatgcaatccgccgaagagtatcgccagctaatcatcgcctaccagaacggcgcgccaattcgtctgggcgatgtcgcaactgtagagcaaggtgcagaaaacagctggctcggcgcgtgggcgaacaaagaacaggccattgtgatgaatgttcagcgccagcccggtgctaacattatctccaccgccgacagcattcggcagatgctgccacagctcactgagagtctgccgaaatcggtgaaggtgacagtgctttccgatcgcaccaccaatatccgcgcatccgtcgatgatactcagtttgaattgatgatggctatcgcgctggtagtcatgattatctacctgtttttgcgcaatattccggcgaccatcattcccggtgttgctgtaccgctgtcgttaatcggcactttcgcggttatggtgtttctcgatttttcaatcaataacctgacactgatggcgttaactatcgccaccggattcgtggtcgatgacgccatcgtggtgatcgaaaacatttcccgctatatcgaaaaaggcgaaaaaccgttggcggcggcgctcaagggcgcaggtgaaatcggctttaccattatctcgctgaccttctcactgattgcggtgttgatcccactgctgtttatgggcgatatcgtcgggcgactgttccgcgaatttgctattaccctggcggtagcgattttgatctcagcggtggtgtcgctgaccctgacaccgatgatgtgcgcgcggatgctcagccaggagtcgttgcgtaaacagaaccgcttctcccgtgcctcggaaaaaatgttcgacaggataatcgccgcctatggtcgtggactggcgaaagtgctgaatcatccgtggctgaccttaagcgtggcactcagcacgctgctgcttagcgtgctgctgtgggtgttcattccgaaaggtttcttcccggtacaggacaatggcattattcagggcactttgcaggcaccgcaatccagctcctttgccaatatggcccagcgacaacgccaggtcgcggacgtgattttgcaggatccggcagtgcaaagcctgacctcatttgttggcgttgatggcactaacccgtcgctgaacagtgcacgtttacaaatcaacctcaaaccgttggatgaacgtgatgatcgggtgcaaaaagtcatcgcccgtctgcaaacggcggtagataaagtgccgggcgtcgatctcttcctgcaaccaacgcaggatctgactattgatactcaggtcagccgcacccagtaccagtttaccttgcaggccacgtcactggatgcgctcagtacctgggtgccacagttgatggaaaaactccagcaactgccacagctttctgatgtctccagcgactggcaggacaaagggctggtggcgtatgtcaatgttgatcgcgacagcgccagccgtctggggatcagcatggcggatgtcgataacgccctgtacaacgcgtttggtcagcggctgatttccactatttatactcaggccaaccagtatcgcgtggtgctggagcacaacaccgaaaataccccaggcctcgcggcgctggataccattcgcctgaccagcagcgacggcggcgtggtgccgctaagctcaattgccaaaattgagcagcgttttgcgccgctctccatcaaccatctggatcagttcccggtaacgaccatctcctttaacgtgccggataactattcgctgggcgatgcggtgcaggcgattatggacaccgaaaagacgctgaatctgccggtggatatcaccacgcagttccagggcagcaccctcgccttccagtcggcgctgggcagcactgtctggctgattgtcgcggcggtggtggcgatgtatatcgtgctcggcattctgtacgagagctttattcacccgatcaccattctctcgacgctacccaccgcaggggttggcgcactgctggcgttgctgattgctggtagcgaactggatgtgattgcgattatcggcattattttgctgatcggtatcgtgaagaagaacgccatcatgatgatcgacttcgcgctggctgctgagcgcgagcaaggcatgtcgccgcgcgaggcaatctaccaggcttgtctgttgcgttttcgtccgatcctgatgaccactctggcggctctgcttggcgcgctgccgctgatgttgagtaccggggtcggcgcggaactgcgtcgtccgttaggtatcggcatggtcggcggtctgattgtcagccaggtgctgacgctgtttaccacgccggtgatttatttgctgttcgaccgcctggcattgtggaccaaaagccgctttgcccgtcatgaagaggaggcgtaa

SEQ ID NO: 272 - DNA, 3078 bp, Escherichia coli
  CDS (1)...(3078)
gtgaagttttttgccctcttcatttaccgcccggtggcgacgattttactgtcggttgccattaccctgtgcggcatactgggcttccgtatgctgccggtcgccccgctgccgcaggtcgattttccggtgattatcgtcagcgcctcgctgcccggtgcgtcaccagaaacaatggcgtcttccgttgccacgccgctggagcgctcacttgggcgcattgccggagtcagtgaaatgacctccagcagttcgctcggcagcacgcgtattattttgcagtttgattttgaccgggatatcaacggcgcagcgcgtgatgtgcaggcggcgatcaacgctgcacaaagtttgctgcccagtgggatgcccagccgcccgacctatcgcaaagcgaacccgtcggatgcgccaattatgatcctcacgctgacgtccgatacttattcgcagggtgaactgtacgatttcgcctcgacgcagctggctccgacgatttcgcaaatcgacggtgttggtgatgtcgatgtcggaggcagctcactgcccgccgtacgcgtcgggctgaatccgcaggcgctgtttaatcagggcgtgtcgctggacgacgtacgcaccgccgtcagcaatgccaacgtgcgtaaaccgcagggcgcgctggaagatggcactcaccgctggcagatccagaccaatgatgagctaaaaaccgccgctgaatatcagccgttgattattcactacaacaacggcggcgcggttcgtctgggcgatgtggcgacggtgaccgactcagtgcaggatgtgcgcaacgccgggatgaccaacgccaaaccggctattttactgatgatccgcaaactgccggaagccaatattatccagacggttgacagcatccgggcaaaattaccggagttgcaggaaaccattccggcggcgattgatctgcaaattgcccaggatcgctcccccaccattcgcgcctcgctggaagaagtcgagcaaacgctgattatctcggtggcgctggtgattctggtggtgtttttattcctgcgctcgggtcgcgccactattattcccgccgtttcggtgccggtttcgctgattggtacgtttgcggcgatgtacctgtgcggattcagtctcaataacctttcgttaatggcgctcaccatcgctactggtttcgtggtggatgacgccatcgtggtgctggaaaacattgcacgtcatctggaagcgggaatgaaaccgttgcaagccgcactgcaaggtactcgcgaagtcggttttacggtgctgtcgatgagtctgtcactggtggcggtgttcctgccgctgctgttgatgggcggattgccgggccgactgttacgcgaatttgccgtgacgctttctgtcgccattggtatatcgttgctggtttctctgacattaacgccaatgatgtgtggctggatgctgaaagccagcaagccgcgcgagcaaaagcgactgcgtggttttggtcgcatgttggtagccctgcaacaaggctacggcaagtcactaaaatgggtgctcaatcatacccgtctggtgggcgtggtgctgcttggcaccattgcgctgaatatctggctgtatatctcgatcccgaaaaccttcttcccggagcaggacactggcgtgttgatgggcgggattcaggcggatcagagtatttcgtttcaggcgatgcgcggtaagttgcaggatttcatgaaaattatccgtgacgatccggcagtggataatgtcaccggctttacaggcggttcgcgagtgaacagcgggatgatgtttatcaccctcaagccacgcgacgaacgcagcgaaacggcgcagcaaattatcgaccgtctgcgcgtaaaactggcgaaagaaccgggggcgaatctgttcctgatggcggtacaggatattcgcgttggtgggcgtcagtcgaacgccagctaccagtacacgttgttatccgacgacctggcggcactgcgagaatgggagccgaaaatccgcaaaaaactggcgacgttgccggaactggcggacgtgaactccgatcagcaggataacggcgcggagatgaatctggtttacgaccgcgacaccatggcacggctgggaatcgacgtacaagccgccaacagtctgttaaataacgccttcggtcagcggcaaatctcgaccatttaccagccgatgaaccagtataaagtggtgatggaagtggatccgcgctatacccaggacatcagtgcgctggaaaaaatgttcgttatcaataacgaaggcaaagcgatcccgctgtcgtatttcgctaaatggcaaccggcgaatgccccactatcggtgaatcatcagggattatcggcggcctcgaccatttcgtttaacctgccgaccggaaaatcgctctcggacgccagtgcggcgatcgatcgcgcaatgacccagcttggtgtgccttcgacggtgcgcggcagttttgccggcacggcgcaggtgttccaggagacgatgaactcgcaggtgatcctgattatcgccgccatcgccacggtgtatatcgtgctgggtatcctttacgagagttacgtacatccgctgacgattctctccaccctgccctcggcgggcgttggagcgctgttggcgctggagctgttcaatgccccgttcagcctaatcgccctgatagggatcatgctattaatcggcatcgtgaagaaaaacgccattatgatggtcgattttgcgcttgaagcccaacggcacggtaacctgacgccgcaggaagctattttccaggcctgtctgctgcgttttcgcccgattatgatgactaccctggcggcgctgtttggtgcgctgccgctggtattgtcgggcggcgacggctcggagctgcggcaacccctggggatcaccattgtcggcggactggtaatgagccagctccttacgctgtataccacgccggtggtgtatctctttttcgaccgtctgcggctgcgtttttcgcgtaaacctaaacaaacggtaaccgagtaa

SEQ ID NO: 273 - DNA, 1416 bp, Escherichia coli
  CDS (1)...(1416)
atgacagatcttcccgacagcacccgttggcaattgtggattgtggctttcggcttctttatgcagtcgctggacaccaccatcgtaaacaccgcccttccctcaatggcgcaaagcctcggggaaagtccgttgcatatgcacatggtcattgtctcttatgtgctgaccgtggcggtgatgctgcccgccagcggctggctggcggacaaagtcggcgtgcgcaatattttctttaccgccatcgtgctgtttactctcggttcactgttttgcgcgctttccggcacgctgaacgaactgttgctggcacgcgcgttacagggcgttggcggcgcgatgatggtgccggtcggcagattgacggtgatgaaaatcgtaccgcgcgagcaatatatggcggcgatgacctttgtcacgttacccggtcaggtcggtccgctgctcggtccggcgctcggcggtctgctggtggagtacgcatcgtggcactggatctttttgatcaacattccggtggggattatcggtgcgatcgccacattgctgttaatgccgaactacaccatgcagacgcggcgctttgatctctccggatttttattgctggcggttggcatggcggtattaaccctggcgctggacggcagtaaaggtacaggtttatcgccgctgacgattgcaggcctggtcgcagttggcgtggtggcactggtgctttatctgctgcacgccagaaataacaaccgtgccctgttcagtctgaaactgttccgtactcgtaccttttcgctgggcctggcggggagctttgccggacgtattggcagtggcatgttgccctttatgacaccggttttcctgcaaattggcctcggtttctcgccgtttcatgccggactgatgatgatcccgatggtgcttggcagcatgggaatgaagcgaattgtggtacaggtggtgaatcgctttggttatcgtcgggtactggtagcgaccacgctgggtctgtcgctggtcaccctgttgtttatgactaccgccctgctgggctggtactacgttttgccgttcgtcctgtttttacaagggatggtcaactcgacgcgtttctcctccatgaacaccctgacgctgaaagatctcccggacaatctggcgagcagcggcaacagcctgctgtcgatgattatgcaattgtcgatgagtatcggcgtcactatcgccgggctgttgctgggactttttggttcacagcatgtcagcgtcgacagcggcaccacacaaaccgtctttatgtacacctggcttagcatggcgttgatcatcgcccttccggcgttcatctttgccagagtgccgaacgatacgcatcaaaatgtagctatttcgcggcgaaaaaggagcgcgcaatga

SEQ ID NO: 274 - DNA, 417 bp, Escherichia coli
  CDS (1)...(417)
gtgattgcgtttgaagtgttgaagtgggcaggcgcggcttacttgatttggctgggaatccagcagtggcgcgccgctggtgcaattgaccttaaatcgctggcctctactcaatcgcgtcgacatttgttccagcgcgcagtttttgtgaatctcaccaatcccaaaagtattgtgtttctggcggcgctatttccgcaattcatcatgccgcaacagccgcaactgatgcagtatatcgtgctcggcgtcaccactattgtggtcgatattattgtgatgatcggttacgccacccttgctcaacggattgctctatggattaaaggaccaaagcagatgaaggcgctgaataagattttcggctcgttgtttatgctggtgggagcgctgttagcatcggcgaggcatgcgtga

SEQ ID NO: 275 - DNA, 774 bp, Escherichia coli
  CDS (1)...(774)
atggctcgtaaatggttgaacttgtttgccggggcggcactctctttcgctgttgctggcaatgcactggcagatgaagggaaaatcacggtgttcgccgccgcatcactgactaacgcaatgcaggacattgctacgcagtttaaaaaagagaaaggcgtggatgtggtttcttctttcgcttcgtcatctactctcgcccgtcagattgaagcgggtgcgcctgcggatctgtttatttctgccgatcagaaatggatggattatgcggttgataaaaaagcgatcgatacagctacgcgtcagacactgctcggcaatagcctggtcgttgtagcaccgaaagccagcgtgcagaaagatttcaccatcgacagcaaaaccaactggacttcactgctgaatggcggtcgcctggcggttggcgatccggaacatgttcccgctggcatttatgcaaaagaagcactgcaaaaactgggcgcatgggatacgctctctccgaaactggccccagcggaagatgttcgtggggcgctggcgctggtcgaacgtaacgaagcgcctctgggcattgtctacggttctgacgcagttgccagcaaaggggtaaaagtggttgccaccttcccggaagattcacataaaaaagtggaatatccggttgctgttgtggaagggcataacaatgcgacagtgaaagcattttatgattatctgaagggaccgcaggcagcggaaatctttaaacgttacggatttacaatcaagtaa

SEQ ID NO: 276 - DNA, 690 bp, Escherichia coli
  CDS (1)...(690)
atgatactgaccgatccagaatggcaggcagttttattaagcctgaaagtttcttccctggctgtgctgtttagcctgccgtttgggatcttttttgcctggttactggtgcgttgcacgtttccgggcaaagctctgctcgacagcgtactgcatctaccgctggtgttaccgcccgtggtcgtcggttacttattattagtttcgatgggacggcgcggatttatcggtgaacgtctgtatgactggtttggtattaccttcgcctttagctggcgcggcgcggttctcgctgccgccgtcatgtcgtttccgctgatggtgcgggcaattcgtctggcgctggaaggggttgatgtcaaactggaacaggccgcaagaacactgggggccgggcgctggcgcgttttctttactatcacgttaccgctgaccttaccgggaattattgttggtacggtactggcttttgctcgttctctcggtgagtttggtgcaaccatcacctttgtgtcgaacattcctggtgaaacgcgaaccattccttctgccatgtataccctgatccagacccccggcggggaaagtggagcggcgagactgtgcattatttctattgcgctggcgatgatctccctgttgatttcagaatggctggccagaatcagccgtgaacgggcggggcgctaa

SEQ ID NO: 277 - DNA, 1059 bp, Escherichia coli
  CDS (1)...(1059)
atgctggaactgaatttttcccagacgttgggcaaccattgcctgactattaatgaaacgctgcccgccaatggcatcactgctatctttggcgtctccggtgccggaaaaacttcgctgattaacgccatcagtggactgacgcgcccgcaaaaagggcggattgtcctcaatgggcgggtactaaatgatgccgaaaaaggtatctgcctgacgccggaaaagcgtcgcgttggctatgtttttcaggatgcgcggctgttcccgcattacaaagtgcgtggcaatctgcgctacggcatgtcgaaaagtatggtcgatcagttcgataagctggtggcgcttttaggcattgaaccgttgcttgaccgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacggctgacacgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggtcaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggaactggaagtcggcggtaaaacgctgtgggcgcgtatcagcccgtgggccagggatgaactggcgatcaaacctggcctgtggctgtacgcgcaaattaaaagtgtgtcgataaccgcctga

SEQ ID NO: 278 - DNA, 507 bp, Escherichia coli
  CDS (1)...(507)
gtgaactccgtcattacacaaaaagtgtcatctggcgttacactttatgcggatactaaaacaggaggttttatgaacagaacgattcttgtccctatcgatatttccgattcagaattaactcaacgcgtgattagccacgttgaggaagaggcaaagattgatgatgcagaggttcatttcctgacggtaataccttcactgccctactatgcctctctgggtttagcgtattccgcagaattaccggcaatggatgacctgaaagcggaagccaaatcgcaactggaagagatcattaaaaaatttaaactgccaaccgacagagtgcatgtccatgttgaggaaggctcgcccaaagaccgcattctggaattggcgaagaagatccccgctcatatgatcatcattgcttcccatcgaccggatatcaccacttatctgctcggttccaacgccgcagctgtagtgcgtcacgcagagtgctccgtgctggttgtgcgctga

SEQ ID NO: 279 - DNA, 1134 bp, Escherichia coli
  CDS (1)...(1134)
atgaaaagcaaagtactggcacttttaattcctgccctgctcgccgcaggtgctgcacatgcagccgaagtttataataaagacggcaacaaattagatctgtatggcaaagttgatggcctgcattatttttctgataattcagcgaaagatggcgaccagagctatgcgcgtctgggttttaaaggcgaaacccaaattaacgatcaactcactggctacggtcaatgggaatacaatattcaggcaaacaacactgaatcttcaaaaaaccagtcatggacccgtctggcatttgccgggctgaaatttgcagattacggttctttcgattacggacgtaattatggcgtaatgtacgacatcgaaggctggaccgatatgctgcctgaatttggcggtgactcttataccaatgcagacaactttatgactggtcgagccaatggcgtcgcgacttatcgtaatactgatttcttcggtctggtaaatggtctgaacttcgcggtgcagtatcaaggtaacaacgaaggagccagtaatggtcaggaaggcaccaacaacggacgtgatgttcgccatgaaaacggtgacggctggggtctttccacaacatatgatttaggcatgggctttagcgctggtgcggcatacacctcttctgaccgcaccaatgaccaggttaaccatactgcggcgggtggtgataaagcagacgcgtggactgctgggctaaaatacgatgctaacaatatttacctggcaaccatgtattcagaaacgcgtaatatgaccccgtttggcgacagcgattatgctgtggcaaacaaaacccagaattttgaagtcactgcacagtaccagtttgattttggtctgcgtccggcagtctctttcctgatgtctaaaggccgtgacctgcacgctgcgggtggtgcagacaacccggcaggtgttgatgataaagatctggttaaatacgccgatattggcgcgacttactatttcaataaaaacatgtccacctacgttgactataaaatcaacctgttggatgaagatgacagcttctacgctgccaatggcatctctaccgatgatattgtcgctttaggtctggtttatcagttctaa

SEQ ID NO: 280 - DNA, 3369 bp, Escherichia coli
  CDS (1)...(3369)
atgttaagggtctaccattccaatcgtctggacgtgctggaagcgttgatggagtttattgtcgaacgcgaacggctggacgatcctttcgaaccagagatgattctggtgcaaagtaccggtatggcacagtggctgcaaatgaccctgtcgcaaaagtttggtattgcggcaaacattgattttccgctgccagcgagctttatctgggatatgttcgtccgggtgttaccggaaatccccaaagagagcgcctttaacaaacagagcatgagctggaaactgatgactctgctgccgcaattgctggagcgcgaagactttaccctgttgcggcattatctgactgacgatagcgacaagcgaaaactgttccagctttcctcaaaagcggcggacctgtttgaccagtatctggtctatcgtccggactggctggcacagtgggaaacaggacatttggttgaagggctgggagaagcacaggcctggcaagccccgttgtggaaggcgctggtggaatatacccatcaactcgggcaaccgcgctggcaccgcgccaatctctatcagcgctttatcgaaacgctggagtccgcgacgacctgcccgccggggttaccttcgcgcgtctttatatgcggtatttccgcgttaccgcctgtttatctccaggcgctacaggcgctgggtaaacatattgaaatccatctcctgtttaccaacccctgccgttattactggggcgatattaaagatcctgcttatctggcgaaactgctgacccgtcagcgtcgacacagttttgaagatcgcgaattgccgctatttcgtgatagcgaaaatgccgggcagctctttaacagcgatggtgaacaggatgtcggcaacccgctgctggcttcatggggtaagcttgggcgcgactacatttatctcctttctgacctggagagcagccaggagctggacgcctttgtcgatgtcacgccagataacctgctgcataacattcagtctgacattctggaactggaaaaccgcgccgttgctggtgtgaacatcgaagagttttcccgtagcgataacaaacgcccgcttgatccactggatagcagtatcaccttccacgtttgccatagcccgcagcgtgaagttgaagttttacacgatcgcctgctggcgatgctggaggaagacccgacacttactccgcgcgacatcatcgtgatggtggctgatatcgacagctacagtccgtttattcaggctgtgtttggtagcgcacctgcggatcgttacctaccttacgccatttccgaccgtcgtgcgcggcagtcacatccggtactggaagcgtttatcagcctgttatcactgcctgacagtcgttttgtgtcagaggatgtgctggcgttgctggatgtgccggtgctggcggcgcggtttgacatcaccgaagaagggctgcgttatttacgccagtgggtcaacgaatccggcattcgttggggcatagatgacgacaacgttcgcgagctggaactccccgccaccggacaacacacctggcgatttggcctgacgcgtatgttgttgggctacgcgatggagagcgcgcagggcgagtggcaatcggttctaccttatgatgaatcgagcggcttaattgcagaactggtggggcatctggcttcactgctaatgcagctaaacatctggcgtcgcgggctggcacaggagcgtccgctggaagagtggttgccggtttgtcgcgatatgctcaacgccttcttcctgccggatgcggaaaccgaagcggcgatgacgctgatcgaacaacaatggcaggcgattatcgccgaaggtttaggtgcgcagtatggcgacgcggtgccgctgtcactattgcgtgatgaactggcacagcgtctggatcaagaacgtatcagccagcgttttctcgccggaccggttaacatttgtactctgatgccaatgcgttcaattccgttcaaagtggtttgcctgctgggaatgaacgacggcgtttatccacgtcagcttgcgccattgggctttgacctgatgagccagaaaccgaagcgtggcgaccgtagccgtcgcgatgacgaccgctatctgttcctggaagcgttaatttccgcgcagcaaaaactctatatcagctatatcggtcgttccattcaggataacagtgagcgtttcccgtcggtactggtgcaggaactgatcgactacatcgggcaaagtcattatctaccgggcgatgaagcgctcaactgtgatgaaagcgaggcaagggtaaaagcgcatcttacttgcctccatacccggatgccgtttgatccacaaaactaccagccaggcgaacgacaaagctatgctcgtgaatggctacctgcggccagccaggctggtaaagcacattctgaatttgttcagccgctgccgtttaccttaccggaaaccgtgccgctggaaacgctacaacgattctgggcacatccggtgcgggcatttttccagatgcgtttgcaggtgaacttccgtactgaagacagcgaaatccccgacaccgagccatttattctggaaggacttagccgttatcaaatcaatcagcagttattgaatgcactggttgagcaggatgatgccgaacgcttgttccgccgcttccgagcggcaggggatttaccgtatggcgcttttggtgaaattttctgggaaacacagtgccaggagatgcagcagcttgccgacagagtcattgcctgtcgccagccggggcagagtatggaaattgatctcgcctgcaacggtgtgcagataactggctggttgccgcaggtgcagccggatggcctgttgcgctggcgtccctctttattaagtgtggcccagggaatgcaactttggctggaacaccttgtctactgtgccagcggtggtaatggtgaaagtcgcctttttctacgcaaagacggcgagtggcgttttccgccgcttgcagccgaacaggctttgcattacctctcacaactgattgaggggtatcgtgaaggaatgtccgcgccattgctggtgttacctgaaagtggcggcgcgtggctaaaaacctgttatgacgcgcaaaacgatgccatgctggatgacgattccacgttgcaaaaagcccgtacgaaattccttcaggcttacgaaggcaacatgatggtgcgtggcgaaggtgatgatatctggtatcaaaggctctggcggcaattaacaccagagacaatggaggccatcgttgaacagtcgcaacgtttcctgttaccgctgtttcgctttaatcagtcatga

SEQ ID NO: 281 - DNA, 324 bp, Escherichia coli
  CDS (1)...(324)
atgtcagcttccctgaagaatcaacaaggctttagcctgccggaggtaatgttggcgatggtgttgatggtgatgattgtcactgcgttatcgggtttccagcgaacattaatgaacagtcttgccagcagaaaccagtaccaacagctctggcggcatggctggcagcaaacgcaactgcgcgcgatttcgccacctgccaactggcaggtcaaccgaatgcagacatcgcaggcgggatgtgtcagcatcagcgttacgctagtttcacccgggggcagagaaggcgagatgacccgcctgcattgcccgaatcgtcagtag

SEQ ID NO: 282 - DNA, 366 bp, Escherichia coli
  CDS (1)...(366)
atgctgctggttttgggtagtttgctattacaaggaatgagccaacaggatcgcagttttgcctctcgcgtgagcatggaaagtcagtcattgcgccgccaggccatcgttcagtcggcgctggcgtggggaaaaatgcactgctggcagacgcagccagcagttcagtgctcgcagtacgctgaaaccgatgcccaggtttgtttgcgtttactggcagataatgaagccttattgattgccggttatgaaggcgtttcgttgtggcgaacaggcgaagtcattgatggaaacattgttttttcgccacgcggctggagcgatttttgtccgctgaaagagagggcgttatgtcagcttccctga

SEQ ID NO: 283 - DNA, 564 bp, Escherichia coli
  CDS (1)...(564)
atgcctgtaaaagagcaaggtttttctctgctggaagtgttgattgctatggcgatcagtagcgtattgttgctgggggcggcacgctttctgcctgcgttacagcgtgaaagtttaacgagcacccgtaagctggcgctggaagatgaaatctggctgcgggtatttaccgtcgcgaagcatctccagagggcgggttattgtcatggcatctgtaccggcgaagggctggaaattgtcggacagggtgactgtgtcattgtgcagtgggatgcgaacagtaacggtatctgggatcgcgaaccggtaaaagagtccgaccagattggatttcgtctgaaggagcatgtgctggaaacgctacgcggtgcgacatcctgtgaaggtaagggctgggataaagtcactaatccggatgccatcattatcgacacttttcaggtcgtacgtcaggatgtcagcggcttctcgccggtgttgacggttaatatgcgtgctgccagtaagtctgaaccgcaaaccgtggtgaatgccagctatagcgtgacaggattcaacctgtga

SEQ ID NO: 284 - DNA, 471 bp, Escherichia coli
  CDS (1)...(471)
atgaaaacacaacgtggttatacgctgattgaaacgctggtcgcgatgctgattttggtcatgctaagcgcaagtggactctatggctggcaatactggcagcagtcgcaacggctatggcaaaccgccagccaggcgcgggactatttgctctatttacgtgaagatgccaactggcataaccgcgaccacagtatcagcgttatcagggaggggacgttatggtgccttgtgagttccgctgctggggccaatacctgtcatggcagttcaccattggtctttgtgccacgctggcccgaagtcgaaatgagcgacctgacaccttcgcttgctttctttggcctgcgcaataccgcatgggccgggcatattcgcttcaaaaactcaacgggcgagtggtggctggtggtttcgccgtggggaagactccggctttgtcagcaaggagaaacagaaggatgcctgtaa

SEQ ID NO: 285 - DNA, 2136 bp, Escherichia coli
  CDS (1)...(2136)
atgagcaccattgtgatttttttagctgctttgctggcctgctcactacttgcgggatggctgataaaagtgcgatccagacggcgtcagctgccctggaccaacgccttcgcggatgcgcaaacgcgtaaactcacacctgaagaacgtagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttacggcatctctaccgacgatccgaataaatggcgttactacctcgattcggtagaagtccacctgccccctttctgggaacagtacatcaacgatgagaataccgttgaactgattcataccgattcgctgccgctggttatttcactcaacggtcatacgctgcaggagtacatgcaggaaactcgcagctatgccttgcaacctgttccgtcaacgcaggcgtcgattcgcggggaagagagtgagcaaatcgagctactcaatattcgcaaagaaacgcatgaagaatatgcgctgagtcgtccgcgcgggctgcgtgaagcgttgctgatcgtcgcctccttcctgatgttctttttctgcctgattaccccggatgtatttgttccgtggctggcaggcggcgcgttactgctgctgggcgcaggtctgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctatcccgcacactggcagccatacattgctcaggatctcggtcaacaaaccgatatcgatatctatctcgaccgccatgtagtgcgtcagggacgatatctttcgctgcatgatgaagtaaaaaactttccgttacagcactggctgcgcagtacgattatcgctgcgggctcgctgctggtgctgtttatgctgttattctggatcccgctggatatgccgctgaaattcactctctcatggatgaaaggcgcgcagaccattgaagccaccagcgtaaaacaactggctgacgctggcgtgcgggtaggcgatacattgcgtattagcggtacgggaatgtgtaatattcgaacttccggaacctggagcgcgaaaaccaattcaccttttttaccgtttgactgctcgcagatcatctggaacgacgcccgctcattgccattaccagaatctgaactggtcaacaaagcgacggcattgactgaagcagttaatcgccagctgcaccctaaaccggaagatgaatctcgcgtcagtgcctcattacgttcagcaattcaaaaatccggcatggtattgcttgatgattttggcgacattgtactgaagacagcggatttatgttctgccaaagatgactgtgtgcgactgaaaaatgcgctggtcaatctcggcaacagtaaagactgggacgcgctggtaaaacgcgccaacgccgggaagctcgatggcgtgaatgtgttattacgcccggtgagtgcggaatcgctggataacctggtggcaacctccaccgcgccgtttatcacgcatgaaacggcgcgagcggcacaatcactaaacagtccggcccccggcggattcctgattgtcagcgacgaaggcagcgattttgttgatcagccctggccttcggcatcactttacgactacccgccgcaagaacagtggaacgctttccagaaactggcacaaatgctgatgcatacgccgtttaacgccgagggtatcgtcacaaaaatcttcactgacgccaatggtacgcagcatattggccttcatccgatcccggatcgttccggcctgtggcgctatctcagcaccacattgctgctactgacgatgctgggtagcgccatttacaatggcgtacaggcctggcgtcgttaccagcgtcatcgcactcgcatgatggagattcaggcctattatgaaagctgcctgaacccgcaactgatcaccccttcagaaagccttatcgaataa

SEQ ID NO: 286 - DNA, 714 bp, Escherichia coli
  CDS (1)...(714)
atgctaccctgtcgcgcaaattgcttcactctggagatttccctcatgcatatcaacattgcctggcaggacgtagataccgttctgctggatatggacggcacgttgctcgacctcgccttcgataactatttctggcaaaagctggtgcctgaaacatggggcgcgaaaaacggggttacgccacaggaagcgatggaatatatgcgccagcaatatcacgacgtacagcatacgctaaactggtactgtcttgattactggagtgagcaactgggtctggatatctgtgcgatgaccaccgagatgggaccgcgtgccgtactgcgtgaagataccattccgtttcttgaggcactgaaagccagcggtaagcagcgaattttgctcaccaatgcgcatccgcacaacctggcggtaaaacttgagcataccggtctggacgcacaccttgatttattactttccacccacacatttggttatccgaaagaggatcagcggttatggcatgcggtggccgaagctacgggtctgaaagctgaaagaacgctgtttattgatgacagcgaagcgattctcgatgctgccgcgcaatttggtattcgttactgcctcggcgtgactaatcctgattccgggattgccgagaaacagtatcaacgccatccgtcactgaatgactaccgccgcctgatcccctcgctaatgtga

SEQ ID NO: 287 - DNA, 402 bp, Escherichia coli
  CDS (1)...(402)
atgaaagagaaacctgctgttgaggttcgactggataaatggctatgggctgcccgtttttataaaacccgcgcgctggcccgtgaaatgattgaaggcggtaaggtgcattacaacgggcagcgcagcaagccgagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcacccggaccgacgcccggacaaaaaagagcgccgcgacctgttacgatttaaacacggcgacagtgaataa

SEQ ID NO: 288 - DNA, 885 bp, Escherichia coli
  CDS (1)...(885)
atgattatgccgcaacatgaccaattacatcgctatctgtttgaaaactttgccgtgcgcggcgaactggtaaccgtttcggaaaccctgcaacagatccttgagaaccacgattatccgcagcccgttaaaaacgtgctggcagaactgctggttgcgaccagcctgttaaccgctacgctgaagtttgatggtgatatcaccgtacagctgcagggcgacggtccgatgaatctggcggttattaacggtaacaataaccagcagatgcgcggtgtggcgcgcgtgcagggcgaaattccagaaaatgccgacctgaaaacgctggtcggcaatggttacgtggtgatcaccattaccccgagcgaaggcgaacgctatcagggcgtagttggtctggaaggtgataccctggcggcctgcctggaagattactttatgcgttctgaacagctgccgacgcgcctgtttattcgcaccggcgacgtagacggcaaaccggctgcaggcggtatgttgttgcaggtaatgcctgcgcaaaatgcccagcaggacgactttgaccacctggcgacgctaaccgaaaccatcaaaaccgaagaactgctgaccttaccggcaaacgaagtgttgtggcgtttgtatcacgaagaagaggtgacggtttacgatccgcaggatgtggagttcaaatgcacctgctcgcgtgaacgttgcgccgatgcgctgaaaacgctgcctgatgaagaagttgatagcatcctggcggaagatggcgaaattgacatgcattgtgattactgcggtaaccactatctgttcaatgcgatggatattgctgaaatccgcaacaacgcgtctccggcagatccgcaagttcattaa

SEQ ID NO: 289 - DNA, 363 bp, Escherichia coli
  CDS (1)...(363)
atgttaaagctatttgcaaagtacacctctattggtgtgctgaacacccttatacactgggtggtttttggtgtttgtatctatgtcgcgcatacaaaccaagctcttgcaaacttcgcaggtttcgttgtggctgtgagctttagcttcttcgcgaatgcaaaattcacattcaaggcatcgactacaacgatgcgctacatgctatatgttgggttcatggggacactgagtgctactgttggatgggctgctgatagatgcgcacttcccccgatgataactcttgtcaccttctccgccatcagcctggtgtgcggtttcgtctattcaaagttcattgtctttagggatgcgaaatga

SEQ ID NO: 290 - DNA, 921 bp, Escherichia coli
  CDS (1)...(921)
atgaagatatctcttgtagttcctgtcttcaatgaagaagaagcgataccaattttttataaaacggtacgtgaattcgaagaattgaagtcatatgaagtggaaatcgttttcataaatgacggcagcaaagacgctacggagtcaatcattaatgctctggctgtttcagatcctctagttgttccgctgtcatttacacgcaactttggtaaagaaccagcattgtttgcagggttagaccatgcaaccggggatgcgataatcccaattgatgttgacctgcaagacccgattgaggttattcctcatcttattgaaaaatggcaagcaggtgctgatatggttcttgctaaaagatctgaccgctcaactgatggacgcctgaagcgaaaaacggctgagtggttctataagctccacaataaaataagcaatcctaaaattgaagagaatgttggtgatttcaggctgatgagccgtgatgttgtcgaaaatattaaacttatgccagaacgaaaccttttcatgaaaggtattctgagctgggtaggaggaaagacagatattgttgaatacgtgcgagcggaaagaattgctggagatacaaaatttaatggatggaaactttggaatttagcacttgagggtattacaagcttttccacattccctcttcgcatctggacatacatagggttagtggtagccagtgtagcatttatttatggggcgtggatgattttagatactatcatatttggaaatgctgttaggggatatccttcactacttgtttcaatactgtttttaggtggaattcagatgattggaataggagtattaggtgaatatattggacgcacatacattgaaaccaaaaaacgcccgaaatacatcatcaagagagtcaaaaaatga

SEQ ID NO: 291 - DNA, 1332 bp, Escherichia coli
  CDS (1)...(1332)
atgaataaagcaataaaagtatcattgtatatatcttttgttttgattatttgcgccttatctaaaaacataatgatgttaaatacatctgatttcggaagagccattaagccattaattgaagacataccagcatttacatatgacttacctttattgtataaattgaaaggtcatattgattcaattgatagctatgagtatataagttcatatagttatattttgtatacatacgtcctgtttattagcatttttactgaatatcttgatgctagggtgttatcgttatttctaaaagtaatatatatttattcattatatgcgatatttacttcatatataaaaacagaaaggtatgtaactttatttacattctttattttagcttttcttatgtgttcttcatcaacactgtcaatgtttgcatcattctatcaagagcaaatagttataattttccttccatttttggtgtattcattaacatgcaaaaacaataaatctatgcttttgctatttttttcgttgctaataatatctactgctaaaaatcaatttatattaaccccactaatagtgtattcatattatattttttttgatagacacaaactaattattaaatctgtaatatgcgtggtgtgcttgcttgcgtcaatatttgcaatatcttattcaaaaggtgttgttgaattaaataagtaccatgcaacatacttcggtagttatctttatatgaaaaacaacgggtataaaatgccatcgtatgttgatgataagtgtgttgggttagatgcctggggtaataaattcgacatatcatttggcgcaaccccaacagaagttggaacggaatgtttcgaatctcataaagatgaaacgttttcgaatgcactctttttattggttagcaaaccaagcaccatcttcaaacttccatttgatgatggtgtgatgtctcagtataaagaaaattatttccatgtatataaaaaactacacgtaatatatggagaatcaaacatactaacgactattactaacataaaagacaatatatttaaaaacattagatttatatcattgttattattttttattgcttctatttttattagaaataataaaataaaggcatctttatttgtagtatctctttttggaatatctcaattttatgtgtcatttttcggggaaggatatagagatttaagcaagcatttatttggaatgtatttttcgttcgacctttgcttatacataacagtcgtttttttaatttataaaataattcaaagaaatcaagacaatagcgatgtaaagcactaa

SEQ ID NO: 292 - DNA, 345 bp, Escherichia coli
  CDS (1)...(345)
ttgattctcgatagacacataacatccaggggttatgtttgtatgcgtcccgcgactatcgccccattaacgccatacgataaatgggatggtgagaaatgggtgacggataccgaggcacagcatagcgtcgcagtagatgcagcagaagcacagcgccagtcgctgattgatactgcaatggcttccattagtctgattcaactgaaattacaggctgggcggaagctgatgcaggcagagacctcccgacttaacactgtgctggattacattgacgcggtgacggcaacagataccagcaccgcgccggatgtcatctggcctgaactgccggaggagtag

SEQ ID NO: 293 - DNA, 447 bp, Escherichia coli
  CDS (1)...(447)
atgaagccacgaaatattaataatagcctaccactgcaaccattagttcctgatcaggagaacaaaaataagaaaaatgaagagaaatccgttaatccagttaaaatcacaatggggtctggtttaaattatattgaacaagaatctcttggaggaaaatatctaacacatgatttgtcaataaagatagcggatatttctgaagagataattcagcaagcaatattatctgctatgagcatatataaattttcgataacagatgatttaatgagtatggctgtaaatgaactcataaaactgaccaaaatagagaataatgtagacctgaataaattcactactatatgcacagacgttctatccccccgcgtcaccagacataataaagaaaaaaacaaacgacattctacccttctcaaaaatcccctttttaattttcattga

SEQ ID NO: 294 - DNA, 504 bp, Escherichia coli
  CDS (1)...(504)
atgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagcagcatgacaaagtcatcgggcattatctgaacataaaacactatcaataa

SEQ ID NO: 295 - DNA, 276 bp, Escherichia coli
  CDS (1)...(276)
gtggcttctgtttctatcagctgtccctcctgttcagctactgacggggtggtgcgtaacggcaaaagcactgccggacatcagcgctatctctgctctcactgccgtaaaacatggcaactgcagttcacttacaccgcttctcaacccggtacgcaccagaaaatcattgatatggccatgaatggcgttggatgccgggcaaccgcccgcattatgggcgttggcctcaacacgattttccgccatttaaaaaactcaggccgcagtcggtaa

SEQ ID NO: 296 - DNA, 4134 bp, Escherichia coli
  CDS (1)...(4134)
atgagcggaaaaccggcagcgcgtcagggcgacatgacgcagtatggcggtagcattgttcagggttcagccggggtgcgcattggtgcccccaccggcgtggcctgttcggtgtgccccggcggagtgacgtccggccatccggtcaatcccctgctcggtgcaaaggtccttcccggtgaaaccgacatcgccctgcccggcccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggttggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgcctggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccacgcggcgaactggcggtggtgtatgaccgtagtggcaaacaggtgcgcagctttacttacgatgataaataccggggccggatggtggcgcaccgtcacacgggccggccggaaatccgttaccgttacgacagcgacgggcgggtgacagaacagctaaacccggcaggcttaagctacacgtatcagtatgagaaagaccgcatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcagggcacagacggatgccgcaggcaggacaacagagtacagcccggatgtggtgacgggcctcatcacgcgcataaccacgccggatggcagggcatcggcgttttactataaccaccacaaccagttaacgtcagccaccgggcctgacgggctggaattgcgccgggaatatgatgaattgggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacatcgccggtgacctgaccgccgtcattgccccggacggcagcagaaacgggacacagtacgatgcgtggggaaaggccgtccgtaccacgcagggcgggctaacgcgcagtatggaatacgatgctgccggacgggtcatccgcctgaccagtgaaaacggcagccacaccaccttccgttacgatgtacttgaccggctgatacaggaaaccggctttgacggccgcacacagcgttatcaccacgacctgaccggcaaacttatccgcagcgaggatgagggtctggtcacccactggcactatgacgaagcagaccgcctcacgcaccgcaccgtgaagggtgaaaccgcagagcggtggcagtatgacgaacgtggctggctgacagacatcagccatatcagcgaagggcaccgggtggcggtgcattacaggtatgatgagaaaggccggctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggttacctggcaggcatgaaactcggcgacacaccgctggtggagtacacccgcgaccgcctgcaccgggaaacgctgcgcagcttcggccgttatgaactcaccaccgcttatacccctgccgggcagttacagagccagcacctgaacagcctgctgtctgaccgcgattacacctggaacgacaacggcgaactcatccgcatcagcagcccgcgccagacccggagttacagctacagcaccaccggcaggctgaccggcgttcacaccaccgcagcgaatctggatatccgcatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcggactcaccggtaccattacgacagtcagcaccggctggtgcactacacgcggacacaatatgaagagccgctggtcgaaagtcgctatctttacgacccgctgggccgcagggtggcaaaacgggtgtggcggcgtgaacgggacctgacgggctggatgtcgctgtcacggaaaccgcaagtgacctggtacggctgggacggcgaccggctgaccacaatacagaacgacagaacccgcatccagacgatttatcagccggggagcttcacgccactcatcagagttgaaaccgccaccggtgagctggcgaaaacgcagcgccgcagcctggcggatgcgcttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgaccgtggagcagatgcaaaaccagatggacccggtgtacacgccggcgcgaaaaatccacctgtaccactgcgaccatcgcggcctgccgctggcccttatcagcaaggaagggacaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggcggtatatcactcaggatccgattgggctgaaggggggatggaatttttatcagtatccgttgaatccagttacgaatacagatcctctggggttagaagtttttcctagaccattccccttgccaattccatggcccaaaagccctgcacagcagcaagcagatgataatgctgcaaaagcattgacaaaatggtggaacgatacagcatcacaaagaatatttgactctctaatattgaataatccgggactagcattagatataacaatgatagcttctcgtggaaatgttgcagacacagggataactgatcgtgtcaatgacataataaatgacagattctggagtgatgggaaaaaacccgacagatgtgacgtacttcaggaactaattgattgtggtgatattagtgctaaagatgcaaaaagcacacagaaagcctggaattgtcgtcactccagacagtcaaacgataaaaaaagatag

SEQ ID NO: 297 - DNA, 843 bp, Escherichia coli
  CDS (1)...(843)
atgtcaaatacataccagaaaagaaaggcaagtaaagagtatggtttatataatcaatgtaagaaactaaatgatgatgaattatttcgcttacttgatgatcacaattccttgaaaaggatttcatctgccagagtattacagttaagaggtgggcaagacgctgttagattggcaattgagttctgctctgataaaaattatatccgtagagatatcggagcatttatactcgggcaaataaaaatttgcaaaaaatgcgaagataatgtttttaatattttgaacaatatggcattgaatgataagagcgcttgcgttcgagctacggcaatcgagtcaacggctcagcgatgcaagaaaaacccaatttattcacctaaaatagtagaacaatctcaaattactgcttttgataaatcgactaatgtcagacgtgctacagcatttgctatttctgttatcaatgataaagcaacaattccactattgattaatctgttaaaagatccaaatggagatgtcagaaactgggccgcatttgcaataaatatcaataaatatgataatagtgatattagggattgttttgtggagatgcttcaggataaaaatgaggaagtccgtattgaagcaataatcggactttcctacagaaaagataaaagggttttatctgttttatgcgatgagttaaaaaaaaatactgtttatgatgatatcattgaagctgcgggtgaattaggtgataaaacgctacttcctgttttagatactatgttgtacaagtttgatgacaatgaaattataacttccgctattgataagctgaagcgttcatag

SEQ ID NO: 298 - DNA, 702 bp, Escherichia coli
  CDS (1)...(702)
gtgcagatgctcgaccggctggaaagtgaaatcctggctgaccgggtgagtgaggaaagccgccgctggctggcatcgtgcggcctgaccgtggagcagatgaaaaaccagatggacccggtgtacacgccggcgcgaaaaatccacctgtaccactgcgaccatcgcggcctgccgctggcccttatcagcaaggaagggacaacagaatggtgcgcagaatacgatgaatggggcaacctgctgaatgaagagaacccgcatcagctgcagcagcttatccgcctgccggggcagcagtatgatgaggagtccggcctgtattacaaccgccaccgctattatgacccgctgcaggggcggtatatcactcaggatccgattgggctgaaggggggatggaatttttatcagtatccgttgaatccggtcataaatgtagatccgcaaggtttggttgatataaatttataccccgaaagtgatcttatccattctgtagctgatgagattaatatcccaggcgttttcacaatcggggggcatggtacccccacatctattgaatccgcaacgcgcagtatcatgacagctaaagatctagcatatctaattaaatttgatgggaattataaagatgggatgacagtttggttattttcttgtaatacaggtaaaggacaaaattcatttgctagctaa

SEQ ID NO: 299 - protein, 320 aa, Escherichia coli
MMIKTRFSRWLTFFTFAAAVALALPAKANTWPLPPAGSRLVGENKFHVVENDGGSLEAIAKKYNVGFLALLQANPGVDPYVPRAGSVLTIPLQTLLPDAPREGIVINIAELRLYYYPPGKNSVTVYPIGIGQLGGDTLTPTMVTTVSDKRANPTWTPTANIRARYKAQGIELPAVVPAGLDNPMGHHAIRLAAYGGVYLLHGTNADFGIGMRVSSGCIRLRDDDIKTLFSQVTPGTKVNIINTPIKVSAEPNGARLVEVHQPLSEKIDDDPQLLPITLNSAMQSFKDAAQTDAEVMQHVMDVRSGMPVDVRRHQVSPQTL

SEQ ID NO: 300 - protein, 728 aa, Escherichia coli
MITRIPRSSFSANINNTAQTNEHQTLSELFYKELEDKFSGKELATPLLKSFSENCRQNGRHIFSNKDFVIKFSTSVLQADKKEITIINKNENTTLTQTIAPIFEKYLMEILPQRSDTLDKQELNLKSDRKEKEFPRIKLNGQCYFPGRPQNRIVCRHIAAQYINDIYQNVDYKPHQDDYSSAEKFLTHFNKKCKNQTLALVSSRPEGRCVAACGDFGLVMKAYFDKMESNGISVMAAILLVDNHALTVRLRIKNTTEGCTHYVVSVYDPNVTNDKIRIMSESKENIKHYSLMDFMNVDYSLLKWSNDHVINQSVAIIPALPKEQLLMLKGSVDEITPPLSPATMNLLMAIGQNHQLTQLMIQLQKMPELHRTEMLTAYNSINLPGLYLAINYGNADIVETIFNSLSETGYEGLLSKKNLMHILEAKDKNGFSGLFLAISRKDKNVVTSILNALPKLAATHHLDNEQVYKFLSAKNRTSSHVLYHVMANGDADMLKIVLNALPLLIRTCHLTKEQVLDLLKAKDFYGCPGLYLAMQNGHSDIVKVILEALPSLAQEINISASDIVDLLTAKSLARDTGLFMAMQRGHMNVINTIFNALPTLFNTFKFDKKNMKPLLLANNSNEYPGLFSAIQHKQQNVVETVYLALSDHARLFGFTAEDIMDFWQHKAPQKYSAFELAFEFGHRVIAELILNTLNKMAESFGFTDNPRYIAEKNYMEALLKKASPHTVR

SEQ ID NO: 301 - protein, 84 aa, Escherichia coli
MTDKIRTLQGRVVSDKMEKSIVVAIERFVKHPIYGKFIKRTTKLHVHDENNECGIGDVVEIRECRPLSKTKSWTLVRVVEKAVL

SEQ ID NO: 302 - protein, 63 aa, Escherichia coli [sequence omitted]

SEQ ID NO: 303 - protein, 136 aa, Escherichia coli [sequence omitted]

SEQ ID NO: 304 - protein, 233 aa, Escherichia coli
MGQKVHPNGIRLGIVKPWNSTWFANTKEFADNLDSDFKVRQYLTKELAKASVSRIVIERPAKSIRVTIHTARPGIVIGKKGEDVEKLRKVVADIAGVPAQINIAEVRKPELDAKLVADSITSQLERRVMFRRAMKRAVQNAMRLGAKGIKVEVSGRLGGAEIARTEWYREGRVPLHTLRADIDYNTSEAHTTYGVIGVKVWIFKGEILGGMAAVEQPEKPAAQPKKQQRKGRK

SEQ ID NO: 305 - protein, 110 aa, Escherichia coli [sequence omitted]

SEQ ID NO: 306 - protein, 92 aa, Escherichia coli
MPRSLKKGPFIDLHLLKKVEKAVESGDKKPLRTWSRRSTIFPNMIGLTIAVHNGRQHVPVFVTDEMVGHKLGEFAPTRTYRGHAADKKAKKK

SEQ ID NO: 307 - protein, 273 aa, Escherichia coli [sequence omitted]

SEQ ID NO: 308 - protein, 100 aa, Escherichia coli [sequence omitted]

SEQ ID NO: 309 - protein, 201 aa, Escherichia coli [sequence omitted]

SEQ ID NO: 310 - protein, 209 aa, Escherichia coli [sequence omitted]

SEQ ID NO: 311 - protein, 103 aa, Escherichia coli
MQNQRIRIRLKAFDHRLIDQATAEIVETAKRTGAQVRGPIPLPTRKERFTVLISPHVNKDARDQYEIRTHLRLVDIVEPTEKTVDALMRLDLAAGVDVQISLG

SEQ ID NO: 312 - protein, 1569 aa, Escherichia coli
MNTIHLRCLFRMNPLVWCLWADVAAKLRSLKRYSVFTFQRMKFMNRTSPYYCRRSVLSLLISALIYAPPGMAAFTTNVIGVVNDETVDGNQKVDERGTTNNTHIINHGQQNVHGGVSNGSLIESGGYQDIGSHNNFVGQANNTTINGGRQSIHDGGISTGTTIESGNQDVYKGGISNGTTIKGGASRVEGGSANGILIDGGSQIVKVQGHADGTTINKSGSQDVVQGSLATNTTINGGRQYVEQSTVETTTIKNGGEQRVYESRALDTTIEGGTQSLNSKSTAKNTHIYSGGTQIVDNTSTSDVIEVYSGGVLDVRGGTATNVTQHDGAILKTNTNGTTVSGTNSEGAFSIHNHVADNVLLENGGHLDINAYGSANKTIIKDKGTMSVLTNAKADATRIDNGGVMDVAGNATNTIINGGTQNINNYGIATGTNINSGTQNIKSGGKADTTIISSGSRQVVEKDGTAIGSNISAGGSLIVYTGGIAHGVNQETGSALVANTGAGTDIEGYNKLSHFTITGGEANYVVLENTGELTVVAKTSAKNTTIDTGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSDKANIKGGKQTVYGLATEANIESGEQIVDGGSTEKTHINGGTQTVQNYGKAINTDIVSGLQQIMANGTAEGSIINGGSQVVNEGGLAENSVLNDGGTLDVREKGSATGIQQSSQGALVATTRATRVTGTRADGVAFSIEQGAANNILLANGGVLTVESDTSSDKTQVNMGGREIVKTKATATGTTLTGGEQIVEGVANETTINDGGIQTVSANGEAIKTKINEGGTLTVNDNGKATDIVQNSGAALQTSTANGIEISGTHQYGTFSISGNLATNMLLENGGNLLVLAGTEARDSTVGKGGAMQNLGQDSATKVNSGGQYTLGRSKDEFQALARAEDLQVAGGTAIVYAGTLADASVSGATGSLSLMTPRDNVTPVKLEGAVRITDSATLTLGNGVDTTLADLTAASRGSVWLNSNNSCAGTSNCEYRVNSLLLNDGDVYLSAQTAAPATTNGIYNTLTTNELSGSGNFYLHTNVAGSRGDQLVVNNNATGNFKIFVQDTGVSPQSDDAMTLVKTGGGDASFTLGNTGGFVDLGTYEYVLKSDGNSNWNLTNDVKPNPDPIPNPKPDPKPDPKPDPNPKPDPTPDPTPTPVPEKRITPSTAAVLNMAATLPLVFDAELNSIRERLNIMKASPHNNNVWGATYNTRNNVTTDAGAGFEQTLTGMTVGIDSRNDIPEGITTLGAFMGYSHSHIGFDRGGHGSVGSYSLGGYASWEHESGFYLDGVVKLNRFKSNVAGKMSSGGAANGSYHSNGLGGHIETGMRFTDGNWNLTPYASLTGFTADNPEYHLSNGMKSKSVDTRSIYRELGATLSYNMRLGNGMEVEPWLKAAVRKEFVDDNRVKVNSDGNFVNYLSGRRGIYQAGIKASFSSTLSGHLGVGYSHSAGVESPWNAVAGVNWSF

SEQ ID NO: 313 - protein, 38 aa, Escherichia coli [sequence omitted]

SEQ ID NO: 314 - protein, 443 aa, Escherichia coli
MAKQPGLDFQSAKGGLGELKRRLLFVIGALIVFRIGSFIPIPGIDAAVLAKLLEQQRGTIIEMFNMFSGGALSRASIFALGIMPYISASIIIQLLTVVHPTLAEIKKEGESGRRKISQYTRYGTLVLAIFQSIGIATGLPNMPGMQGLVINPGFAFYFTAVVSLVTGTMFLMWLGEQITERGIGNGISIIIFAGIVAGLPPAIAHTIEQARQGDLHFLVLLLVAVLVFAVTFFVVFVERGQRRIVVNYAKRQQGRRVYAAQSTHLPLKVNMAGVIPAIFASSIILFPATIASWFGGGTGWNWLTTISLYLQPGQPLYVLLYASAIIFFCFFYTALVFNPRETADNLKKSGAFVPGIRPGEQTAKYIDKVMTRLTLVGALYITFICLIPEFMRDAMKVPFYFGGTSLLIVVVVIMDFMAQVQTLMMSSQYESALKKANLKGYGR

SEQ ID NO: 315 - protein, 144 aa, Escherichia coli [sequence omitted]

SEQ ID NO: 316 - protein, 59 aa, Escherichia coli [sequence omitted]

SEQ ID NO: 317 - protein, 167 aa, Escherichia coli
MAHIEKQAGELQEKLIAVNRVSKTVKGGRIFSFTALTVVGDGNGRVGFGYGKAREVPAAIQKAMEKARRNMINVALNNGTLQHPVKGVHTGSRVFMQPASEGTGIIAGGAMRAVLEVAGVHNVLAKAYGSTNPINVVRATIDGLENMNSPEMVAAKRGKSVEEILGK

SEQ ID NO: 318 - protein, 117 aa, Escherichia coli [sequence omitted]

SEQ ID NO: 319 - protein, 177 aa, Escherichia coli [sequence omitted]

SEQ ID NO: 320 - protein, 130 aa, Escherichia coli
MSMQDPIADMLTRIRNGQAANKAAVTMPSSKLKVAIANVLKEEGFIEDFKVEGDTKPELELTLKYFQGKAVVESIQRVSRPGLRIYKRKDELPKVMAGLGIAVVSTSKGVMTDRAARQAGLGGEIICYVA

SEQ ID NO: 321 - protein, 101 aa, Escherichia coli
MAKQSMKAREVKRVALADKYFAKRAELKAIISDVNASDEDRWNAVLKLQTLPRDSSPSRQRNRCRQTGRPHGFLRKFGLSRIKVREAAMRGEIPGLKKASW

SEQ ID NO: 322 - protein, 179 aa, Escherichia coli [sequence omitted]

SEQ ID NO: 323 - protein, 104 aa, Escherichia coli [sequence omitted]

SEQ ID NO: 324 - protein, 123 aa, Escherichia coli [sequence omitted]

SEQ ID NO: 325 - protein, 396 aa, Escherichia coli
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTRITK

SEQ ID NO: 326 - protein, 514 aa, Escherichia coli
MDVIKKKHWWQSDALKWSVLGLLGLLVGYLVVLMYAQGEYLFAITTLILSSAGLYIFANRKAYAWRYVYPGMAGMGLFVLFPLVCTIAIAFTNYSSTNQLTFERAQEVLLDRSWQAGKTYNFGLYPAGDEWQLALSDGETGKNYLSDAFKFGGEQKLQLKETTAQPEGERANLRVITQNRQALSDITAILPDGNKVMMSSLRQFSGTQPLYTLDGDGTLTNNQSGVKYRPNNQIGFYQSITADGNWGDEKLSPGYTVTTGWKNFTRVFTDEGIQKPFLAIFVWTVVFSLITVFLTVAVGMVLACLVQWEALRGKAVYRVLLILPYAVPSFISILIFKGLFNQSFGEINMMLSALFGVKPAWFSDPTTARTMLIIVNTWLGYPYMMILCMGLLKAIPDDLYEASAMDGAGPFQNFFKITLPLLIKPLTPLMIASFAFNFNNFVLIQLLTNGGPDRLGTTTPAGYTDLLVNYTYRIAFEGGGGQDFGLAAAIATLIFLLVGALAIVNLKATRMKFD

SEQ ID NO: 327 - protein, 296 aa, Escherichia coli
MAMVQPKSQKARLFITHLLLLLFIAAIMFPLLMVVAISLRQGNFATGSLIPEQISWDHWKLALGFSVEQADGRITPPPFPVLLWLWNSVKVAGISAIGIVALSTTCAYAFARMRFPGKATLLKGMLIFQMFPAVLSLVALYALFDRLGEYIPFIGLNTHGGVIFAYLGGIALHVWTIKGYFETIDSSLEEAAALDGATPWQAFRLVLLPLSVPILAVVFILSFIAAITEVPVASLLLRDVNSYTLAVGMQQYLNPQNYLWGDFAAAAVMSALPITIVFLLAQRWLVNGLTAGGVKG

SEQ ID NO: 328 - protein, 673 aa, Escherichia coli
MRLNPGQQQAVEFVTGPCLVLAGAGSGKTRVITNKIAHLIRGCGYQARHIAAVTFTNKAAREMKERVGQTLGRKEARGLMISTFHTLGLDIIKREYAALGMKANFSLFDDTDQLALLKELTEGLIEDDKVLLQQLISTISNWKNDLKTPSQAAASAIGERDRIFAHCYGLYDAHLKACNVLDFDDLILLPTLLLQANEEVRKRWQNKIRYLLVDEYQDTNTSQYELVKLLVGSRARFTVVGDDDQSIYSWRGARPQNLVLLSQDFPALKVIKLEQNYRSSGRILKAANILIANNPHVFEKRLFSELGYGAELKVLSANNEEHEAERVTGELIAHHFVNKTQYKDYAILYRGNHQSRVFEKFLMQNRIPYKISGGTSFFSRPEIKDLLAYLRVLTNPDDDSAFLRIVNTPKREIGPATLKKLGEWAMTRNKSMFTASFDMGLSQTLSGRGYEALTRFTHWLAEIQRLAEREPIAAVRDLIHGMDYESWLYETSPSPKAAEMRMKNVNQLFSWMTEMLEGSELDEPMTLTQVVTRFTLRDMMERGESEEELDQVQLMTLHASKGLEFPYVYMVGMEEGFLPHQSSIDEDNIDEERRLAYVGITRAQKELTFTLCKERRQYGELVRPEPSRFLLELPQDDLIWEQERKVVSAEERMQKGQSHLANLKAMMAAKRGK

SEQ ID NO: 329 - protein, 403 aa, Escherichia coli
MMVTVVSNYCQLSQTQLSQTFAEKFTVTEELLQSLKKTALSGDEESIELLHNIALGYDKFGKEAEDILYHIVRTPTNETLSIIRLIKNACLKLYNLAHIATNSPLKSHDSDDLLFKKLFSPSKLMTIIGDEIPLISEKQSLSKVLLNDENNELSDGTNFWDKNRQLTTDEIACYLQKIAANAKNTQVNYPTGLYVPYSTRTHLEDALNENIKSDPSWPNEVQLFPINTGGHWILVSLQKIVNKKNNKLQIKCVIFNSLRALGYDKENSLKRVINSFNSELMGEMSNNNIKVHLNEPEIIFLHADLQQYLSQSCGAFVCMAAQEVIEQRESNSDSAPYTLLKNHADRFKKYSAEEQYEIDFQHRLANRNCYLDKYGDANINHYYRNLEIKHSQPKNRASGKRVS

SEQ ID NO: 330 - protein, 296 aa, Escherichia coli
MMFKQYLQVTKPGIIFGNLISVIGGFLLASKGSIDYPLFIYTLVGVSLVVASGCVFNNYIDRDIDRKMERTKNRVLVKGLISPAVSLVYATLLGIAGFMLLWFGANPLACWLGVMGFVVYVGVYSLYMKRHSVYGTLIGSLSGAAPPVIGYCAVTGEFDSGAAILLAIFSLWQMPHSYAIAIFRFKDYQAANIPVLPVVKGISVAKNHITLYIIAFAVATLMLSLGGYAGYKYLVVAAAVSVWWLGMALRGYKVADDRIWARKLFGFSIIAITALSVMMSVDFMVPDSHTLLAAVW

SEQ ID NO: 331 - protein, 315 aa, Escherichia coli
MRLRKYNKSLGWLSLFAGTVLLSGCNSALLDPKGQIGLEQRSLILTAFGLMLIVVIPAILMAVGFAWKYRASNKDAKYSPNWSHSNKVEAVVWTVPILIIIFLAVLTWKTTHALEPSKPLAHDEKPITIEVVSMDWKWFFIYPEQGIATVNEIAFPANTPVYFKVTSNSVMNSFFIPRLGSQIYAMAGMQTRLHLIANEPGTYDGISASYSGPGFSGMKFKAIATPDRAAFDQWVAKAKQSPNTMSDMAAFEKLAAPSEYNQVEYFSNVKPDLFADVINKFMAHGKSMDMTQPEGEHSAHEGMEGMDMSHAESAH

SEQ ID NO: 332 - protein, 663 aa, Escherichia coli
MFGKLSLDAVPFHEPIVMVTIAGIILGGLALVGLITYFGKWTYLWKEWLTSVDHKRLGIMYIIVAIVMLLRGFADAIMMRSQQALASAGEAGFLPPHHYDQIFTAHGVIMIFFVAMPFVIGLMNLVVPLQIGARDVAFPFLNNLSFWFTVVGVILVNVSLGVGEFAQTGWLAYPPLSGIEYSPGVGVDYWIWSLQLSGIGTTLTGINFFVTILKMRAPGMTMFKMPVFTWASLCANVLIIASFPILTVTVALLTLDRYLGTHFFTNDMGGNMMMYINLIWAWGHPEVYILILPVFGVFSEIAATFSRKRLFGYTSLVWATVCITVLSFIVWLHHFFTMGAGANVNAFFGITTMIIAIPTGVKIFNWLFTMYQGRIVFHSAMLWTIGFIVTFSVGGMTGVLLAVPGADFVLHNSLFLIAHFHNVIIGGVVFGCFAGMTYWWPKAFGFKLNETWGKRAFWFWIIGFFVAFMPLYALGFMGMTRRLSQQIDPQFHTMLMIAASGAVLIALGILCLVIQMYVSIRDRDQNRDLTGDPWGGRTLEWATSSPPPFYNFAVVPHVHERDAFWEMKEKGEAYKKPDHYEEIHMPKNSGAGIVIAAFSTIFGFAMIWHIWWLAIVGFAGMIITWIVKSFDEDVDYYVPVAEIEKLENQHFDEITKAGLKNGN

SEQ ID NO: 333 - protein, 204 aa, Escherichia coli
MATDTLTHATAHAHEHGHHDAGGTKIFGFWIYLMSDCILFSILFATYAVLVNGTAGGPTGKDIFELPFVLVETFLLLFSSITYGMAAIAMYKNNKSQVISWLALTWLFGAGFIGMEIYEFHHLIVNGMGPDRSGFLSAFFALVGTHGLHVTSGLIWMAVLMVQIARRGLTSTNRTRIMCLSLFWHFLDVVWICVFTVVYLMGAM

SEQ ID NO: 334 - protein, 109 aa, Escherichia coli
MSHSTDHSGASHGSVKTYMTGFILSIILTVIPFWMVMTGAASPAVILGTILAMAVVQVLVHLVCFLHMNTKSDEGWNMTAFVFTVLIIAILVVGSIWIMWNLNYNMMMH

SEQ ID NO: 335 - protein, 587 aa, Escherichia coli
MQWQTKLPLIAILRGITPDEALAHVGAVIDAGFDAVEIPLNSPQWEQSIPAIVDAYGDKALIGAGTVLKPEQVDALARMGCQLIVTPNIHSEVIRRAVGYGMTVCPGCATATEAFTALEAGAAGAENISVIGFWSAIHQSVKSGIAIGHRSLCRWRRDAENLAQWIDAGCAGAGLGSDLYRAGQSVERTAQQAAAFVKAYREAGAMKITKITTYRLPPRWMFLKIETDEGVVGWGEPVIEGRARTVEAAVHELGDYLIGQDPSRINDLWQVMYRAGFYRGGPILMSAIAGIDQALWDIKGKVLNAPVWQLMGGLVRDKIKAYSWVGGDRPADVIDGIKTLREIGFDTFKLNGCEELGLIDNSRAVDAAVNTVAQIREAFGNQIEFGLDFHGRVSAPMAKVLIKELEPYRPLFIEEPVLAEQAEYYPKLAAQTHIPLAAGERMFSRFDFKRVLEAGGISILQPDLSHAGGITECYKIAGMAEAYDVTLAPHCPLGPIALAACLHIDFVSYNAVLQEQSMGIHYNKGAELLDFVKNKEDFSMVGGFFKPLTKPGLGVEIDEAKVIEFSKNAPDWRNPLWRHEDNSVAEW

SEQ ID NO: 336 - protein, 292 aa, Escherichia coli
MTARYIAIDWGSTNLRAWLYQGDHCLESRQSEAGVTRLNGKSPAAVLAEVTTDWREEKTPVVMAGMVGSNVGWKVAPYLSVPACFSSIGEQLTSVGDNIWIIPGLCVSHDDNHNVMRGEETQLIGARALAPSSLYVMPGTHCKWVQADSQQINDFRTVMTGELHHLLLNHSLIGAGLPPQENSADAFTAGLERGLNTPAILPQLFEVRASHVLGTLPREQVSEFLSGLLIGAEVASMRDYVAHQHAITLVAGTSLTARYQQAFQAMGCDVTAVAGDTAFQAGIRSIAHAVAN

SEQ ID NO: 337 - protein, 128 aa, Escherichia coli
MTLNKTDRIVITLGKQIVHGKYVPGSPLPAEAELCEEFATSRNIIREVFRSLMAKRLIEMKRYRGAFVAPRNQWNYLDTDVLQWVLENDYDPRLISAMSEVRNLVEPAIARWEQSARLPAIWRRLNRR

SEQ ID NO: 338 - protein, 98 aa, Escherichia coli
MIANNQDREAFNEADIRYHEAVLQSVHNPVLQQLSIAISSLQRAVFERTWMGDEANMPQTLQEHKALFDAIRHQDGDAAEQAALTMIASSTRRLKEIT

SEQ ID NO: 339 - protein, 118 aa, Escherichia coli [sequence omitted]

SEQ ID NO: 340 - protein, 65 aa, Escherichia coli [sequence omitted]

SEQ ID NO: 341 - protein, 180 aa, Escherichia coli
MKGGKRVQTARPNRINGEIRAQEVRLTGLEGEQLGIVSLREALEKAEEAGVDLVEISPNAEPPVCRIMDYGKFLYEKSKSSKEQKKKQKVIQVKEIKFRPGTDEGDYQVKLRSLIRFLEEGDKAKITLRFRGREMAHQQIGMEVLNRVKDDLQELAVVESFPTKIEGRQMIMVLAPKKKQ

SEQ ID NO: 342 - protein, 642 aa, Escherichia coli
MPVITLPDGSQRHYDHAVSPMDVALDIGPGLAKACIAGRVNGELVDACDLIENDAQLSIITAKDEEGLEIIRHSCAHLLGHAIKQLWPHTKMAIGPVIDNGFYYDVDLDRTLTQEDVEALEKRMHELAEKNYDVIKKKVSWHEARETFANRGESYKVSILDENIAHDDKPGLYFHEEYVDMCRGPHVPNMRFCHHFKLMKTAGAYWRGDSNNKMLQRIYGTAWADKKALNAYLQRLEEAAKRDHRKIGKQLDLYHMQEEAPGMVFWHNDGWTIFRELEVFVRSKLKEYQYQEVKGPFMMDRVLWEKTGHWDNYKDAMFTTSSENREYCIKPMNCPGHVQIFNQGLKSYRDLPLRMAEFGSCHRNEPSGSLHGLMRVRGFTQDDAHIFCTEEQIRDEVNGCIRLVYDMYSTFGFEKIVVKLSTRPEKRIGSDEMWDRAEADLAVALEENNIPFEYQLGEGAFYGPKIEFTLYDCLDRAWQCGTVQLDFSLPSRLSASYVGEDNERKVPVMIHRAILGSMERFIGILTEEFAGFFPTWLAPVQVVIMNITDSQSEYVNELTQKLSNAGIRVKADLRNEKIGFKIREHTLRRVPYMLVCGDKEVESGKVAVRTRRGKDLGSMDVNEVIEKLQQEIRSRSLKQLEE

SEQ ID NO: 343 - protein, 330 aa, Escherichia coli
MKIKNILLTLCTSLLLTNVAAHAKEVKIGMAIDDLRLERWQKDRDIFVKKAESLGAKVFVQSANGNEETQMSQIENMINRGVDVLVIIPYNGQVLSNVVKEAKQEGIKVLAYDRMINDADIDFYISFDNEKVGELQAKALVDIVPQGNYFLMGGSPVDNNAKLFRAGQMKVLKPYVDSGKIKVVGDQWVDGWLPENALKIMENALTANNNKIDAVVASNDATAGGAIQALSAQGLSGKVAISGQDADLAGIKRIAAGTQTMTVYKPITLLANTAAEIAVELGNGQEPKADTTLNNGLKDVPSRLLTPIDVNKNNIKDTVIKDGFHKESEL

SEQ ID NO: 344 - protein, 55 aa, Escherichia coli
MNKFIKVALVGAVLATLTACTGHIENRDKNCSYDYLLHPAISISKIIGGCGPTAQ

SEQ ID NO: 345 - protein, 462 aa, Escherichia coli
MTANSPLQRIGQEKGIAMGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRSRQLNALS

SEQ ID NO: 346 - protein, 347 aa, Escherichia coli
MLSGENKMLDIDKSTVDFLVTENMVQEVEKVLSHDVPLVHAIVEEMVKRDIDRIYFVACGSPLNAAQTAKHLADRFSDLQVYAISGWEFCDNTPYRLDDRCAVIGVSDYGKTEEVIKALELGRACGALTAAFTKRADSPITSAAEFSIDYQADCIWEIHLLLCYSVVLEMITRLAPNAEIGKIKNDLKQLPNALGHLVRTWEEKGRQLGELASQWPMIYTVAAGPLRPLGYKEGIVTLMEFTWTHGCVIESGEFRHGPLEIVEPGVPFLFLLGNDESRHTTERAINFVKQRTDNVIVIDYAEISQGLHPWLAPFLMFVPMEWLCYYLSIYKDHNPDERRYYGGLVEY

SEQ ID NO: 347 - protein, 149 aa, Escherichia coli
MNAAITVVWWNINPSPGPATGRIYARSYPMKTGMFTCGHQRLPIEHAFRDASELGYDGIEIWGGRPHAFAPDLKAGGIKQIKALAQTYQMPIIGYTPETNGYPYNMMLGDEHMRRESLDMIKLAMDMAKEMNAGYTLISAGPRGLSHAT

SEQ ID NO: 348 - protein, 127 aa, Escherichia coli
MRDIQMVLERWGAWAANNHEDVTWSSIAAGFKGLITSKVKSRPQCCDDDAMIICGCMARLKKNNSDLHDLLVDYYVVGMTFMSLAGKHCCSDGYIGKRLQKAEGIIEGMLMALDIRLEMDIVVNNSN

SEQ ID NO: 349 - protein, 453 aa, Escherichia coli
MFDNLTDRLSRTLRNISGRGRLTEDNVKDTLREVRMALLEADVALPVVREFINRVKEKAVGHEVNKSLTPGQEFVKIVRNELVAAMGEENQTLNLAAQPPAVVLMAGLQGAGKTTSVGKLGKFLREKHKKKVLVVSADVYRPAAIKQLETLAEQVGVDFFPSDVGQKPVDIVNAALKEAKLKFYDVLLVDTAGRLHVDEAMMDEIKQVHASINPVETLFVVDAMTGQDAANTAKAFNEALPLTGVVLTKVDGDARGGAALSIRHITGKPIKFLGVGEKTEALEPFHPDRIASRILGMGDVLSLIEDIESKVDRAQAEKLASKLKKGDGFDLNDFLEQLRQMKNMGGMASLMGKLPGMGQIPDNVKSQMDDKVLVRMEAIINSMTMKERAKPEIIKGSRKRRIAAGCGMQVQDVNRLLKQFDDMQRMMKKMKKGGMAKMMRSMKGMMPPGFPGR

SEQ ID NO: 350 - protein, 577 aa, Escherichia coli
MKQQIQLRRREVDETADLPAELPPLLRRLYASRGVRSAQELERSVKGMLPWQQLSGVEKAVEILYNAFREGTRIIVVGDFDADGATSTALSVLAMRSLGCSNIDYLVPNRFEDGYGLSPEVVDQAHARGAQLIVTVDNGISSHAGVEHARSLGIPVIVTDHHLPGDTLPAAEAIINPNLRDCNFPSKSLAGVGVAFYLMLALRTFLRDQGWFDERNIAIPNLAELLDLVALGTVADVVPLDANNRILTWQGMSRIRAGKCRPGIKALLEVANRDAQKLAASDLGFALGPRLNAAGRLDDMSVGVALLLCDNIGEARVLANELDALNQTRKEIEQGMQIEALTLCEKLERSRDTLPGGLAMYHPEWHQGVVGILASRIKERFHRPVIAFAPAGDGTLKGSGRSIQGLHMRDALERLDTLYPGMMLKFGGHAMAAGLSLEEDKFKLFQQRFGELVTEWLDPSLLQGEVVSDGPLSPAEMTMEVAQLLRDAGPWGQMFPEPLFDGHFRLLQQRLVGERHLKVMVEPVGGGPLLDGIAFNVDTALWPDNGVREVQLAYKLDINEFRGNRSLQIIIDNIWPI

SEQ ID NO: 351 - protein, 236 aa, Escherichia coli
MKKGFMLFTLLAAFSGFAQADDAAIQQTLAKMGIKSSDIQPAPVAGMKTVLTNSGVLYITDDGKHIIQGPMYDVSGTAPVNVTNKMLLKQLNALEKEMIVYKAPQEKHVITVFTDITCGYCHKLHEQMADYNALGITVRYLAFPRQGLDSDAEKEMKAIWCAKDKNKAFDDVMAGKSVAPASCDVDIADHYALGVQLGVSGTPAVVLSNGTLVPGYQPPKEMKEFLDEHQKMTSGK

SEQ ID NO: 352 - protein, 298 aa, Escherichia coli
MKQDLARIEQFLDALWLEKNLAENTLNAYRRDLSMMVEWLHHRGLTLATAQSDDLQALLAERLEGGYKATSSARLLSAVRRLFQYLYREKFREDDPSAHLASPKLPQRLPKDLSEAQVERLLQAPLIDQPLELRDKAMLEVLYATGLRVSELVGLTMSDISLRQGVVRVIGKGNKERLVPLGEEAVYWLETYLEHGRPWLLNGVSIDVLFPSQRAQQMTRQTFWHRIKHYAVLAGIDSEKLSPHVLRHAFATHLLNHGADLRVVQMLLGHSDLSTTQIYTHVATERLRQLHQQHHPRA

SEQ ID NO: 353 - protein, 246 aa, Escherichia coli
MFFNTKHTTALCFVTCMAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVNGLNGKANSAKVHFYAINDFGGAIEGNARL

SEQ ID NO: 354 - protein, 865 aa, Escherichia coli
MTIEYTKNYHHLTRIATFCALLYCNTAFSAELVEYDHTFLMGQNASNIDLSRYSEGNPAIPGVYDVSVYVNDQPIINQSITFVAIEGKKNAQACITLKNLLQFHINSPDINNEKAVLLARDETLGNCLNLTEIIPQASVRYDVNDQRLDIDVPQAWVMKNYQNYVDPSLWENGINAAMLSYNLNGYHSETPGRKNESIYAAFNGGMNLGAWRLRASGNYNWMTDSGSNYDFKNRYVQRDIASLRSQLILGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSTSWGSYSVSAQRSWNEDGDTDDSVYLSFTIPIEKLLGTEQRTSGFQSIDTQISSDFKGNNQLNVSSSGYSDNARVSYSVNTGYTMNKASKDLSYVGGYASYESPWGTLAGSISANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEQSKPVSCLAHYQQSPEAEKIAQSIILNGIRCQIQ

SEQ ID NO: 355 - protein, 661 aa, Escherichia coli
MKTVRESTTLYNFLGSHNPYWRLTESSDVLRFSTTETTEPDRTLQLSAEQAARIREMTVITSSLMMSLTVDESDLSVHLVGRKINKREWAGNASAWHDTPAVARDLSHGLSFAEQVVSEAHSAIVILDSRGNIQRFNRLCEDYTGLKEHDVIGQSVFKLFMSRREAAASRRNNRVFFRSGNAYEVELWIPTCKGQRLFLFRNKFVHSGSGKNEIFLICSGTDITEERRAQERLRILANTDSITGLPNRNAMQDLIDHAINHADNNKVGVVYLDLDNFKKVNDAYGHLFGDQLLRDVSLAILSCLEHDQVLARPGGDEFLVLASNTSQSALEAMASRILTRLRLPFRIGLIEVYTSCSVGIALSPEHGSDSTAIIRHADTAMYTAKEGGRGQFCVFTPEMNQRVFEYLWLDTNLRKALENDQLVIHYQPKITWRGEVRSLEALVRWQSPERGLIPPLDFISYAEESGLIVPLGRWVILDVVRQVAKWRDKGINLRVAVNISARQLADQTIFTALKQVLQELNFEYCPIDVELTESCLIENDELALSVIQQFSQLGAQVHLDDFGTGYSSLSQLARFPIDAIKLDQVFVRDIHKQPVSQSLVRAIVAVAQALNLQVIAEGVESAKEDAFLTKNGINERQGFLFAKPMPAVAFERWYKRYLKRA

SEQ ID NO: 356 - protein, 230 aa, Escherichia coli
MMTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 357 - protein, 867 aa, Escherichia coli
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADASRHEGDSIRFLYAKSMNTFGTNFQLMGYRYSTQGFYTLDDVAYRRMEGYEYDYDGEHRDEPIIVNYHNLRFSRKDRLQLNVSQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGGGYNYDRDQHDVNWQLSGGVVGHENGITLSQPLGDTNVLIKAPGAGGVRIENQTGILTDWRGYAVMLYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 358 - protein, 325 aa, Escherichia coli
MACLCLANISWATVCANSTGVAEDEHYDLSNIFNSTNNQPGQIVVLPEKSGWVGVSAICPPGTLVNYTYRSYVTNFIVQETIDNYKYMQLHDYLLGAMSLVDSVMDIQFPPQNYIRMGTDPNVSQNLPFGVMDSRLIFRLKVIRPFINMVEIPRQVMFTVYVTSTPYDPLVTPVYTISFGGRVEVPQNCELNAGQIVEFDFGDIGASLFSAAGPGNRPAGVMPQTKSIAVKCTNVAAQAYLTMRLEASAVSGQAMVSDNQDLGFIVADQNDTPITPNDLNSVIPFRLDAAAAANVTLRAWPISITGQKPTEGPFSALGYLRVDYQ

SEQ ID NO: 359 - protein, 171 aa, Escherichia coli
MRRVLFSCFCGLLWSSSGWAVDPLGTININLHGNVVDFSCTVNTADIDKTVDLGRWPTTQLLNAGDTTALVPFSLRLEGCPPGSVAILFTGTPASDTNLLALDDPAMAQTVAIELRNSDRSRLALGEASPTEEVDANGNVTLNFFANYRALASGVRPGVAKADAIFMINYN

SEQ ID NO: 360 - protein, 194 aa, Escherichia coli
MFGYRSNVPKVRLTTDRLVVRLVHDRDAWRLADYYAENRHFLKPWEPVRDESHCYPSGWQARLGMINEFHKQGSAFYFGLFDPDEKEIIGVANFSNVVRGSFHACYLGYSIGQKWQGKGLMFEALTAAIRYMQRTQHIHRIMANYMPHNKRSGDLLARLGFEKEGYAKDYLLIDGQWRDHVLTALTTPDWTPGR

SEQ ID NO: 361 - protein, 215 aa, Escherichia coli
MKYQLTALEARVIGCLLEKQVTTPEQYPLSVNGVVTACNQKTNREPVMNLSESEVQEQLDNLVKRHYLRTVSGFGNRVTKYEQRFCNSEFGDLKLSAAEVALITTLLLRGAQTPGELRSRAARMYEFSDMAEVESTLEQLANREDGPFVVRLAREPGKRENRYMHLFSGEVEDQPAVTDMSNAVDGDLQARVEALEIEVAELKQRLDSLLAHLGD

SEQ ID NO: 362 - protein, 307 aa, Escherichia coli [sequence omitted]

SEQ ID NO: 363 - protein, 239 aa, Escherichia coli
MLKRVFLSLLVLIGLLLLTVLGLDRWMSWKTAPYIYDELQDLPYRQVGVVLGTAKYYRTGVINQYYRYRIQGAINAYNSGKVNYLLLSGDNALQSYNEPMTMRKDLIAAGVDPSDIVLDYAGFRTLDSIVRTRKVFDTNDFIIITQRFHCERALFIALHMGIQAQCYAVPSPKDMLSVRIREFAARFGALADLYIFKREPRFLGPLVPIPAMHQVPEDAQGYPAVTPEQLLELQKKQGK

SEQ ID NO: 364 - protein, 79 aa, Escherichia coli
MDVQQFFVVAVFFLIPIFCFREAWKGWRAGAIDKRVKNAPEPVYVWRAKNPGLFFAYMVAYIGFGILSIGMIVYLIFYR

SEQ ID NO: 365 - protein, 510 aa, Escherichia coli
MATIDSMNKDTTRLSDGPDWTFDLLDVYLAEIDRVAKLYRLDTYPHQIEVITSEQMMDAYSSVGMPINYPHWSFGKKFIETERLYKHGQQGLAYEIVINSNPCIAYLMEENTITMQALVMAHACYGHNSFFKNNYLFRSWTDASSIVDYLIFARKYITECEERYGVDEVERLLDSCHALMNYGVDRYKRPQKISLQEEKARQKSREEYLQSQVNMLWRTLPKREEEKTVAEARRYPSEPQENLLYFMEKNAPLLESWQREILRIVRKVSQYFYPQKQTQVMNEGWATFWHYTILNHLYDEGKVTERFMLEFLHSHTNVVFQPPYNSPWYSGINPYALGFAMFQDIKRICQSPTEEDKYWFPDIAGSDWLETLHFAMRDFKDESFISQFLSPKVMRDFRFFTVLDDDRHNYLEISAIHNEEGYREIRNRLSSQYNLSNLEPNIQIWNVDLRGDRSLTLRYIPHNRAPLDRGRKEVLKHVHRLWGFDVMLEQQNEDGSIELLERCPPRMGNL

SEQ ID NO: 366 - protein, 452 aa, Escherichia coli
MKRLSITVRLTLLFILLLSVAGAGIVWTLYNGLASELKWRDDTTLINRTAQIKQLLIDGVNPDTLPVYFNRMMDVSQDILIIHGDSINKIVNRTNVSDGMLNNIPASETISAAGIYRSIINDTEIDALRINIDEVSPSLTVTVAKLASARHNMLEQYKINSIIICIVAIVLCSVLSPLLIRTGLREIKKLSGVTEALNYNDSREPVEVSALPRELKPLGQALNKMHHALVKDFERLSQFADDLAHELRTPINALLGQNQVTLSQTRSIAEYQKTIAGNIEELENISRLTENILFLARADKNNVLVKLDSLSLNKEVENLLDYLEYLSDEKEICFKVECNQQIFADKILLQRMLSNLIVNAIRYSPEKSRIHITSFLDTNSYLNIDIASPGTKINEPEKLFRRFWRGDNSRHSVGQGLGLSLVKAIAELHGGSATYHYLNKHNVFRITLPQRN

SEQ ID NO: 367 - protein, 239 aa, Escherichia coli
MNQAVSITYDLWHIIFMKILLIEDNQRTQEWVTQGLSEAGYVIDAVSDGRDGLYLALKDDYALIILDIMLPGMDGWQILQTLRTAKQTPVICLTARDSVDDRVRGLDSGANDYLVKPFSFSELLARVRAQLRQHHALNSTLEISGLRMDSVSHSVSRDNISITLTRKEFQLLWLLASRAGEIIPRTVIASEIWGINFDSDTNTVDVAIRRLRAKVDDPFPEKLIATIRGMGYSFVAVKK

SEQ ID NO: 368 - protein, 172 aa, Escherichia coli
MILKSAISADSLLAKDAFRASFHLHFLRNHGITNKISLVSYIVWQERYATDITDPQSGEFMTIKNKMLLGALLLVTSAAWAAPATAGSTNTSGISKYELSSFIADFKHFKPGDTVPEMYRTDEYNIKQWQLRNLPAPDAGTHWTYMGGAYVLISDTDGKIIKAYDGEIFYHR

SEQ ID NO: 369 - protein, 274 aa, Escherichia coli
MTEFTTLLQQGNAWFFIPSAILLGALHGLEPGHSKTMMAAFIIAIKGTIKQAVMLGLAATISHTAVVWLIAFGGMVISKRFTAQSAEPWLQLISAVIIISTAFWMFWRTWRGERNWLENMHGHDYEHHHHDHEHHHDHGHHHHHEHGEYQDAHARAHANDIKRRFDGREVTNWQILLFGLTGGLIPCPAAITVLLICIQLKALTLGATLVVSFSIGLALTLVTVGVGAAISVQQVAKRWSGFNTLAKRAPYFSSLLIGLVGVYMGVHGFMGIMR

SEQ ID NO: 370 - protein, 82 aa, Escherichia coli
MCIGVPGQVLAVGEDIHQLAQVEVCGIKRDVNIALICEGNPADLLGQWVLVHVGFAMSIIDEDEAKATLDALRQMDYDITSA

SEQ ID NO: 371 - protein, 113 aa, Escherichia coli
MHELSLCQSAVEIIQRQAEQHDVKRVTAVWLEIGALSCVEESAVRFSFEIVCHGTVAQGCDLHIVYKPAQAWCWDCSQVVEIHQHDAQCPLCHGERLRVDTGDSLIVKSIEVE

SEQ ID NO: 372 - protein, 162 aa, Escherichia coli
MTEEIAGFQTSPKAQVQAAFEEIARRSMHDLSFLHPSMPVYVSDFTLFEGQWTGCVITPWMLSAVIFPGPDQLWPLRKVSEKIGLQLPYGTMTFTVGELDGVSQYLSCSLMSPLSHSMSIEEGQRLTDDCARMILSLPVTNPDVPHAGRRALLFGRRSGENA

SEQ ID NO: 373 - protein, 164 aa, Escherichia coli
MRILVLGVGNILLTDEAIGVRIVEALEQRYILPDYVEILDGGTAGMELLGDMANRDHLIIADAIVSKKNAPGTMMILRDEEVPALFTNKISPHQLGLADVLSALRFTGEFPKKLTLVGVIPESLEPHIGLTPTVEAMIEPALEQVLAALRESGVEAIPREAIHD

SEQ ID NO: 374 - protein, 567 aa, Escherichia coli
MSQRITIDPVTRIEGHLRIDCEIENGVVSKAWASGTMWRGMEEIVKNRDPRDAWMIVQRICGVCTTTHALSSVRAAESALNIDVPVNAQYIRNIILAAHTTHDHIVHFYQLSALDWVDITSALQADPTKASEMLKGVSTWHLNSPEEFTKVQNKIKDLVASGQLGIFANGYWGHPAMKLPPEVNLIAVAHYLQALECQRDANRVVALLGGKTPHIQNLAVGGVANPINLDGLGVLNLERLMYIKSFIDKLSDFVEQVYKVDTAVIAAFYPEWLTRGKGAVNYLSVPEFPTDSKNGSFLFPGGYIENADLSSYRPITSHSDEYLIKGIQESAKHSWYKDEAPQAPWEGTTIPAYDGWSDDGKYSWVKSPTFYGKTVEVGPLANMLVKLAAGRESTQNKLNEIVAIYQKLTGNTLEVAQLHSTLGRIIGRTVHCCELQDILQNQYSALITNIGKGDHTTFVKPNIPATGEFKGVGFLEAPRGMLSHWMVIKDGIISNYQAVVPSTWNSGPRNFNDDVGPYEQSLVGTPVADPNKPLEVVRTIHSFDPCMACAVHVVDADGNEVVSVKVL

SEQ ID NO: 375 - protein, 392 aa, Escherichia coli
MSHDPQPLGGKIISKPVMIFGPLIVICMLLIVKRLVFGLGSVSDLNGGFPWGVWIAFDLLIGTGFACGGWALAWAVYVFNRGQYHPLVRPALLASLFGYSLGGLSITIDVGRYWNLPYFYIPGHFNVNSVLFETAVCMTIYIGVMALEFAPALFERLGWKVSLQRLNKVMFFIIALGALLPTMHQSSMGSLMISAGYKVHPLWQSYEMLPLFSLLTAFIMGFSIVIFEGSLVQAGLRGNGPDEKSLFVKLTNTISVLLAIFIVLRFGELIYRDKLSLAFAGDFYSVMFWIEVLLMLFPLVVLRVAKLRNDSRMLFLSALSALLGCATWRLTYSLVAFNPGGGYAYFPTWEELLISIGFVAIEICAYIVLIRLLPILPPLKQNDHNRHEASKA

SEQ ID NO: 376 - protein, 328 aa, Escherichia coli
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGEKEGGGTQVLVLTGVPYENLDLPKLDDLSTGARSENIQHTLYKGMMLPLAVLAGLTVLVRRNTKNDHHDGGDDHES

SEQ ID NO: 377 - protein, 824 aa, Escherichia coli
MLQCGAKNVNPLERFVSSLPVAAVLPELLTALDCAPQVLLSAPTGAGKSTWLPLQLLAHPGINGKIILLEPRRLAARNVAQRLAELLNEKPGDTVGYRMRAQNCVGPNTRLEVVTEGVLTRMIQRDPELSGVGLVILDEFHERSLQADLALALLLDVQQGLRDDLKLLIMSATLDNDRLQQMLPEAPVVISEGRSFPVERRYLPLPAHQRFDDAVAVATAEMLRQESGSLLLFLPGVGEIQRVQEQLASRIGSDVLLCPLYGALSLNDQRKAILPAPQGMRKVVLATNIAETSLTIEGIRLVVDCAQERVARFDPRTGLTRLITQRVSQASMTQRAGRAGRLEPGISLHLIAKEQAERAAAQSEPEILQSDLSGLLMELLQWGCSDPAQMSWLDQPPVVNLLAAKRLLQMLGALEGERLSAQGQKMAALGNDPRLAAMLVSAKNDDEAATAAKIAAILEEPPRMGNSDLGVAFSRNQPAWQQRSQQLLKRLNVRGGEADSSLIAPLLAGAFADRIARRRGQDGRYQLANGMGAMLDANDALSRHEWLIAPLLLQGSASPDARILLALLVDIDELVQRCPQLVQQSDTVEWDDAQGTLKAWRRLQIGQLTVKVQPLAKPSEDELHQAMLNGIRDKGLSVLNWTAEAEQLRLRLLCAAKWLPEYDWPAVDDESLLAALETWLLPHMTGVHSLRGLKSLDIYQALRGLLDWGMQQRLDSELPAHYTVPTGSRIAIRYHEDNPPALAVRMQEMFGEATNPTIAQGRVPLVLELLSPAQRPLQITRDLSDFWKGAYREVQKEMKGRYPKHVWPDDPANTAPTRRTKKYS

SEQ ID NO: 378 - protein, 316 aa, Escherichia coli
MSKLDTFIQHAVNAVPVSGTSLISSLYGDSLSHRGGEIWLGSLAALLEGLGFGERFVRTALFRLNKEGWLDVSRIGRRSFYSLSDKGLRLTRRAESKIYRAEQPAWDGKWLLLLSEGLDKSTLADVKKQLIWQGFGALAPSLMASPSQKLADVQTLLHEAGVADNVICFEAQIPLALSRAALRARVEECWHLTEQNAMYETFIQSFRPLVPLLKEAADELTPERAFHIQLLLIHFYRRVVLKDPLLPEELLPAHWAGHTARQLCINIYQRVAPAALAFVSEKGETSVGELPAPGSLYFQRFGGLNIEQEALCQFIR

SEQ ID NO: 379 - protein, 196 aa, Escherichia coli
MPIYQIDGLTPVVPEESFVHPTAVLIGDVILGKGVYVGPNASLRGDFGRIVVKDGANIQDNCVMHGFPEQDTVVGEDGHIGHSAILHGCIIRRNALVGMNAVVMDGAVIGENSIVGASAFVKAKAEMPANYLIVGSPAKAIRELSEQELAWKKQGTHEYQVLVTRCKQTLHQVEPLREIEPGRKRLVFDENLRPKQ

SEQ ID NO: 380 - protein, 426 aa, Escherichia coli
MKHLTEMVRQHKAGKTNGIYAVCSAHPLVLEAAIRYASANQTPLLIEATSNQVDQFGGYTGMTPADFRGFVCQLADSLNFPQDALILGGDHLGPNRWQNLPAAQAMANADDLIKSYVAAGFKKIHLDCSMSCQDDPIPLTDDIVAERAARLAKVAEETCLEHFGEADLEYVIGTEVPVPGGAHETLSELAVTTPDAARATLEAHRHAFEKQGLNAIWPRIIALVVQPGVEFDHTNVIDYQPAKASALSQMVENYETLIFEAHSTDYQTPQSLRQLVIDHFAILKVGPALTFALREALFSLAAIEEELVPAKACSGLRQVLEDVMLDRPEYWQSHYHGDGNARRLARGYSYSDRVRYYWPDSQIDDAFAHLVRNLADSPIPLPLISQYLPLQYVKVRSGELQPTPRELIINHIQDILAQYHTACEGQ

SEQ ID NO: 381 - protein, 169 aa, Escherichia coli
MKANKQNKEEHAMPNIVLSRIDERLIHGQVGVQWVGFAGANLVLVANDEVAEDPVQQNLMEMVLAEGIAVRFWTLQKVIDNIHRAADRQKILLVCKTPADFLTLVKGGVPVNRINVGNMHYANGKQQIAKTVSVDAGDIAAFNDLKTAGVECFVQGVPTEPAVDLFKLL

SEQ ID NO: 382 - protein, 133 aa, Escherichia coli
MEISLLQAFALGIIAFIAGLDMFNGLTHMHRPVVLGPLVGLVLGDLHTGILTGGTLELVWMGLAPLAGAQPPNVIIGTIVGTAFAITTGVKPDVAVGVAVPFAVAVQMGITFLFSVMSGVMSRCDLATNPRRI

SEQ ID NO: 383 - protein, 167 aa, Escherichia coli
MHCYNGMTGLHHREPGMVGAGLTDKRAWLELIADGHHVHPAAMSLCCCCAKERIVLITDAMQAAGMPDGRYTLCGEEVQMHGGVVRTASGGLAGSTLSVDAAVRNMVELTGVTPAEAIHMASLHPARMLGVDGVLGSLKPGKRARVVALDSGLHVQQIWIQGQLASF

SEQ ID NO: 384 - protein, 384 aa, Escherichia coli
MPENYTPAAAATGTWTEEEIRHQPRAWIRSLTNIDALRSALNNFLEPLLRKENLRIILTGAGTSAFIGDIIAPWLASHTGKNFSAVPTTDLVTNPMDYLNPAHPLLLISFGRSGNSPESVAAVELANQFVPECYHLPITCNEAGALYQNAINSDNAFALLMPAETHDRGFAMTSSITTMMASCLAVFAPETINSQTFRDVADRCQAILTSLGDFSEGVFGYAPWKRIVYLGSGGLQGAARESALKVLELTAGKLAAFYDSPTGFRHGPKSLVDDETLVVVFVSSHPYTRQYDLDLLAELRRDNQAMRVIAIAAESSDIVAAGPHIILPPSRHFIDVEQAFCFLMYAQTFALMQSLHMGNTPDTPSASGTVNRVVQGVIIHPWQA

SEQ ID NO: 385 - protein, 286 aa, Escherichia coli
MSIISTKYLLQDAQANGYAVPAFNIHNAETIQAILEVCSEMRSPVILAGTPGTFKHIALEEIYALCSAYSTTYNMPLALHLDHHESLDDIRRKVHAGVRSAMIDGSHFPFAENVKLVKSVVDFCHSQDCSVEAELGRLGGVEDDMSVDAESAFLTDPQEAKRFVELTGVDSLAVAIGTAHGLYSKTPKIDFQRLAEIREVVDVPLVLHGASDVPDEFVRRTIELGVTKVNVATELKIAFAGAVKAWFAENPQGNDPRYYMRVGMDAMKEVVRNKINVCGSANRISA

SEQ ID NO: 386 - protein, 118 aa, Escherichia coli
MARIAGINIPDHKHAVIALTSIYGVGKTRSKAILAAAGIAEDVKISELSEGQIDTLRDEVAKFVVEGDLRREISMSIKRLMDLGCYRGLRHRRGLPVRGQRTKTNARTRKGPRKPIKK

SEQ ID NO: 387 - protein, 129 aa, Escherichia coli
MAKAPIRARKRVRKQVSDGVAHIHASFNNTIVTITDRQGNALGWATAGGSGFRGSRKSTPFAAQVAAERCADAVKEYGIKNLEVMVKGPGPGRESTIRALNAAGFRITNITDVTPIPHNGCRPPKKRRV

SEQ ID NO: 388 - protein, 206 aa, Escherichia coli
MARYLGPKLKLSRREGTDLFLKSGVRAIDTKCKIEQAPGQHGARKPRLSDYGVQLREKQKVRRIYGVLERQFRNYYKEAARLKGNTGENLLALLEGRLDNVVYRMGFGATRAEARQLVSHKAIMVNGRVVNIASYQVSPNDVVSIREKAKKQSRVKAALELAEQREKPTWLEVDAGKMEGTFKRKPERSDLSADINEHLIVELYSK

SEQ ID NO: 389 - protein, 329 aa, Escherichia coli [sequence omitted]

SEQ ID NO: 390 - protein, 127 aa, Escherichia coli [sequence omitted]

SEQ ID NO: 391 - protein, 243 aa, Escherichia coli
MKMLRDPLFWLIALFVALIFWLPYSQPLFAALFPQLPRPVYQQESFAALALAHFWLVGISSLFAVIIGTGAGIAVTRPWGAEFRPLVETIAAVGQTFPPVAVLAIAVPVIGFGLQPAIIALILYGVLPVLQATLAGLGAIDASVTEVAKGMGMSRGQRVRKVELPLAAPVILAGVRTSVIINIGTATIASTVGASTLGTPIIIGLSGFNTAYVIQGALLVALAAIIADRLFERLVQALSQHAK

SEQ ID NO: 392 - protein, 308 aa, Escherichia coli
MIEFSHVSKLFGAQKAVNDLNLNFQEGSFSVLIGTSGSGKSTTLKMINRLVEHDSGEIRFAGEEIRSLPVLELRRRMGYAIQSIGLFPHWSVAQNIATVPQLQKWSRARIDDRIDELMALLGLESNLRERYPHQLSGGQQQRVGVARALAADPQVLLMDEPFGALDPVTRGALQQEMTRIHRLLGRTIVLVTHDIDEALRLAEHLVLMDHGEVVQQGNPLTMLTRPANDFVRQFFGRSELGVRLLSLRSVADYVRREERADGEALAEEMTLRDALSLFVARGCEVLPVVNMQGQPCGTLHFQDLLVEA

SEQ ID NO: 393 - protein, 385 aa, Escherichia coli
MTYFRINPVLALLLLLTAIAAALPFISYAPNRLVSGEGRHLWQLWPQTIWMLVGVGCAWLTACFIPGKKGSICALILAQFVFVLLVWGAGKAATQLAQNGSALARTSLGSGFWLAAALALLACSDAIRRISTHPLWRWLLHMQIAIIPLWLLYSGTLNDLSLMKEYANRQDVFDDALAQHLTLLFGAVLPALVIGVPLGIWCYFSTARQGAIFSLLNVIQTVPSVALFGLLIAPLAALVTAFPWLGTLGIAGTGMTPALIALVLYALLPLVRGVVVGLNQIPRDVLESARAMGMSGAQRFLHVQLPLALPVFLRSLRVVMVQTVGMAVIAALIGAGGFGALVFQGLLSSAIDLVLLGVIPVIVLAVLTDALFDLLIALLKVKRND

SEQ ID NO: 394 - protein, 305 aa, Escherichia coli
MPLLKLWAGSLVMLAAVSLPLQAASPVKVGSKIDTEGALLGNIILQVLESHGVPTVNKVQLGTTPVVRGAITSGELDIYPEYTGNGAFFFKDENDAAWKNAQQGYEKVKKLDSEHNKLIWLTPAPANNTWTIAVRQDVAEKNKLTSLADLSRYLQEGGTFKLAASAEFIERADALPAFEKAYGFKLGQDQLLSLAGGDTAVTIKAAAQQTSGVNAAMAYGTDGPVAALGLQTLSDPQGVQPIYAPAPVVRESVLREYPQMAQWLQPVFASLDAKTLQQLNASIAVEGLDAKKVAADYLKQKGWTK

SEQ ID NO: 395 - protein, 207 aa, Escherichia coli
MLVYWLDIVGTAVFAISGVLLAGKLRMDPFGVLVLGVVTAVGGGTIRDMALDHGPVFWVKDPTDLVVAMVTSMLTIVLVRQPRRLPKWMLPVLDAVGLAVFVGIGVNKAFNAEAGPLIAVCMGVITGVGGGIIRDVLAREIPMILRTEIYATACIIGGIVHATAYYTFSVPLETASMMGMVVTLLIRLAAIRWHLKLPTFALDENGR

SEQ ID NO: 396 - protein, 266 aa, Escherichia coli
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 397 - protein, 232 aa, Escherichia coli
MKIGIIGAMEEEVTLLRDKIENRQTISLGGCEIYTGQLNGTEVALLKSGIGKVAAALGATLLLEHCKPDVIINTGSAGGLAPTLKVGDIVVSDEARYHDADVTAFGYEYGQLPGCPAGFKADDKLIAAAEACIAELNLNAVRGLIVSGDAFINGSVGLAKIRHNFPQAIAVEMEATAIAHVCHNFNVPFVVVRAISDVADQQSHLSFDEFLAVAAKQSSLMVESLVQKLAHG

SEQ ID NO: 398 - protein, 262 aa, Escherichia coli
MIDKSAFVHPTAIVEEGASIGANAHIGPFCIVGPHVEIGEGTVLKSHVVVNGHTKIGRDNEIYQFASIGEVNQDLKYAGEPTRVEIGDRNRIRESVTIHRGTVQGGGLTKVGSDNLLMINAHIAHDCTVGNRCILANNATLAGHVSVDDFAIIGGMTAVHQFCIIGAHVMVGGCSGVAQDVPPYVIAQGNHATPFGVNIEGLKRRGFSREAITAIRNAYKLIYRSGKTLDEVKPEIAELAETYPEVKAFTDFFARSTRGLIR

SEQ ID NO: 399 - protein, 382 aa, Escherichia coli [sequence omitted]

SEQ ID NO: 400 - protein, 198 aa, Escherichia coli
MIEFVYPHTQLVAGVDEVGRGPLVGAVVTAAVILDPARPIAGLNDSKKLSEKRRLALYEEIKEKALSWSLGRAEPHEIDELNILHATMLAMQRAVAGLHIAPEYVLIDGNRCPKLPMPAMAVVKGDSRVPEISAASILAKVTRDAEMAALDIVFPQYGFAQHKGYPTAFHLEKLAEHGATEHHRRSFGPVKRALGLAS

SEQ ID NO: 401 - protein, 1160 aa, Escherichia coli
MSEPRFVHLRVHSDYSMIDGLAKTAPLVKKAAALGMPALAITDFTNLCGLVKFYGAGHGAGIKPIVGADFNVQCDLLGDELTHLTVLAANNTGYQNLTLLISKAYQRGYGAAGPIIDRDWLIELNEGLILLSGGRMGDVGRSLLRGNSALVDECVAFYEEHFPDRYFLELIRTGRPDEESYLHAAVELAEARGLPVVATNDVRFIDSSDFDAHEIRVAIHDGFTLDDPKRPRNYSPQQYMRSEEEMCELFADIPEALANTVEIAKRCNVTVRLGEYFLPQFPTGDMSTEDYLVKRAKEGLEERLAFLFPDEEERLKRRPEYDERLETELQVINQMGFPGYFLIVMEFIQWSKDNGVPVGPGRGSGAGSLVAYALKITDLDPLEFDLLFERFLNPERVSMPDFDVDFCMEKRDQVIEHVADMYGRDAVSQIITFGTMAAKAVIRDVGRVLGHPYGFVDRISKLIPPDPGMTLAKAFEAEPQLPEIYEADEEVKALIDMARKLEGVTRNAGKHAGGVVIAPTKITDFAPLYCDEEGKHPVTQFDKSDVEYAGLVKFDFLGLRTLTIINWALEMINKRRAKNGEPPLDIAAIPLDDKKSFDMLQRSETTAVFQLESRGMKDLIKRLQPDCFEDMIALVALFRPGPLQSGMVDNFIDRKHGREEISYPDVQWQHESLKPVLEPTYGIILYQEQVMQIAQVLSGYTLGGADMLRRAMGKKKPEEMAKQRSVFAEGAEKNGINAELAMKIFDLVEKFAGYGFNKSHSAAYALVSYQTLWLKAHYPAEFMAAVMTADMDNTEKVVGLVDECWRMGLKILPPDINSGLYHFHVNDDGEIVYGIGAIKGVGEGPIEAIIEARNKGGYFRELFDLCARTDTKKLNRRVLEKLIMSGAFDRLGPHRAALMNSLGDALKAADQHAKAEAIGQADMFGVLAEEPEQIEQSYASCQPWPEQVVLDGERETLGLYLTGHPINQYLKEIERYVGGVRLKDMHPTERGKVITAAGLVVAARVMVTKRGNRIGICTLDDRSGRLEVMLFTDALDKYQQLLEKDRILIVSGQVSFDDFSGGLKMTAREVMDIDEAREKYARGLAISLTDRQIDDQLLNRLRQSLEPHRSGTIPVHLYYQRADARARLRFGATWRVSPSDRLLNDLRGLIGSEQVELEFD

SEQ ID NO: 402 - protein, 239 aa, Escherichia coli
MNVNFFVTCIGDALKSRMARDSVLLLEKLGCRVNFPEKQGCCGQPAINSGYIKEAIPGMKNLIAALEDNDDPIISPAGSCTYAVKSYPTYLADEPEWASRAAKVAARMQDLTSFIVNKLGVVDVGASLQGRAVYHPSCSLARKLGVKDEPLTLLKNVRGLELLTFAEQDTCCGFGGTFSVKMAEISGEMVKEKVAHLMEVRPEYLIGADVSCLLNISGRLQREGQKVKVMHIAEVLMSR

SEQ ID NO: 403 - protein, 475 aa, Escherichia coli
MSIKTSNTDFKTRIRQQIEDPIMRKAVANAQQRIGANRQKMVDELGHWEEWRDRAAQIRDHVLSNLDAYLYQLSEKVTQNGGHVYFARTKEDATRYILQVAQRKNARKVVKSKSMVTEEIGVNHVLQDAGIQVIETDLGEYILQLDQDPPSHVVVPAIHKDRHQIRRVLHERLGYEGPETPEAMTLFIRQKIREDFLSAEIGITGCNFAVAETGSVCLVTNEGNARMCTTLPKTHIAVMGMERIAPTFAEVDVLITMLARSAVGARLTGYNTWLTGPREAGHVDGPEEFHLVIVDNGRSEVLASEFRDVLRCIRCGACMNTCPAYRHIGGHGYGSIYPGPIGAVISPLLGGYKDFKDLPYACSLCTACDNVCPVRIPLSKLILRHRRVMAEKGITAKAEQRAIKMFAYANSHPGLWKVGMMAGAHAASWFINGGKTPLKFGAISDWMEARDLPEADGESFRSWFKKHQAQEKKNG

SEQ ID NO: 404 - protein, 282 aa, Escherichia coli
MLMRQAGLSMAAKHHSNLARLATGWKHAIFLKLTERVSVVGLRNIRRRRKRMDNRGEFLNNVAQALGRPLRLEPQAEDAPLNNYANERLTQLNQQQRCDAFIQFASDVMLTRCELTSEAKAAEAAIRLCKELGDQSVVISGDTRLEELGISERLQQECNAVVWDPAKGAENISQAEQAKVGVVYAEYGLTESGGVVLFSAAERGRSLSLLPEYSLFILRKSTILPRVAQLAEKLHQKAQAGERMPSCINIISGPSSTADIELIKVVGVHGPVKAVYLIIEDC

SEQ ID NO: 405 - protein, 390 aa, Escherichia coli
MSEIAMHVTAKPSSFQCNLKCDYCFYLEKESQFTHEKWMDDSTLKEFIKQYIAASGNQVYFTWQGGEPTLAGLDFFRKVIHYQQRYAGQKRIFNALQTNGILLNNEWCAFLKEHEFLVGISIDGPQELHDRYRRSNSGNGTFAKVIAAIERLKSYQVEFNTLTVINNVNVHYPLEVYHFLKSIGSKHMQFIELLETGTPNIDFSGHSENTFRIIDFSVPPTAYGKFMSTIFMQWVKNDVGEIFIRQFESFVSRFLGNGHTSCIFQESCKDNLVVESNGDIYECDHFVYPQYKIGNINKSELKTMNSVQLTAQKKRIPAKCQQCAYKPICNGGCPKHRITKVNNETVSYFCEGYKILFSTMVPYMNAMVELAKNRVPLYHIMDVAKQMENN

SEQ ID NO: 406 - protein, 571 aa, Escherichia coli
MELSTIRRGTFMKSALKKSVVSTSISLILASGMAAFAAHAADDVKLKATKTNVAFSDFTPTEYSTKGKPNIIVLTMDDLGYGQLPFDKGSFDPKTMENREVVDTYKIGIDKAIEAAQKSTPTLLSLMDEGVRFTNGYVAHGVSGPSRAAIMTGRAPARFGVYSNTDAQDGIPLTETFLPELFQNHGYYTAAVGKWHLSKISNVPVPEDKQTRDYHDNFTTFSAEEWQPQNRGFDYFMGFHAAGTAYYNSPSLFKNRERVPAKGYISDQLTDEAIGVVDRAKTLDQPFMLYLAYNAPHLPNDNPAPDQYQKQFNTGSQTADNYYASVYSVDQGVKRILEQLKKNGQYDNTIILFTSDNGAVIDGPLPLNGAQKGYKSQTYPGGTHTPMFMWWKGKLQPGNYDKLISAMDFYPTALDAADISIPKDLKLDGVSLLPWLQDKKQGEPHKNLTWITSYSHWFDEENIPFWDNYHKFVRHQSDDYPHNPNTEDLSQFSYTVRNNDYSLVYTVENNQLGLYKLTDLQQKDNLAAANPQVVKEMQGVVREFIDSSQPPLSEVNQEKFNNIKKALSEAK

SEQ ID NO: 407 - protein, 274 aa, Escherichia coli; identical to SEQ ID NO: 369

SEQ ID NO: 408 - protein, 172 aa, Escherichia coli; identical to SEQ ID NO: 368

SEQ ID NO: 409 - protein, 567 aa, Escherichia coli
MAFVSEREIVRKIFSKKIDFTILAFFYISSIFFLLCSGVLFQYFTAAFTKGNCYECSMKLDYIKQFYFSLETAWYLISAVAVFIASVFIQHRIKAYLTLLAITWIVLTITDVALIHALDNIAMNNILLNILYNLFGAILLSLFMCLSNSLLFHLNKIKHIPMILSAMIPLVSAIIIAILITAVIYLLFARQAVEIEMDISEGSDIAYVGVKDNEESFGFLNDKKTDTPTYLDVIKNGSLIYNDTQGLSGADIYIVSGCYALPDLLRNVPLDAKKSFLNVKKLEITQKLPMMGFIQGESADVMPKAASRLSLSKQDDKFMLASSVTDSQIKFKSNNAQLMVAFAFMPITTNGILHDYTYDIIINDKKYKIENHVAPLSRLDKNKKMKCEYQQISDLTNTYNINANYLTGFLLVLKPDDIINYNNSPSVLLKTDFAFYKKTYQKLDKIYDDISNGKLSSLRATGISQFSINGKHLSLRPESEIIISEGSLYGLVNKSKKIKIYGTADLVFVDNKIMNLRKITYLQSKLEIFGSSIMDILKYIFGLGLLAISIKFIHSYFKNDVNENLFL

SEQ ID NO: 410 - protein, 363 aa, Escherichia coli
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 411 - protein, 121 aa, Escherichia coli
MMSTTLFKDFTFEAAHRLPHVPEGHKCGRLHGHSFMVRLEITGEVDPHTGWIIDFAELKAAFKPTYERLDHHYLNDIPGLENPTSEVLAKWIWDQVKPVVPLLSAVMVKETCTAGCIYRGE

SEQ ID NO: 412 - protein, 433 aa, Escherichia coli
MLCSGYLGHDMEDDCDIIIIGAGIAGTACALRCARAGLSVLLLERAEIPGSKNLSGGRLYTHALAELLPQFHLTAPLERRITHESLSLLTPDGVTTFSSLQPGGESWSVLRARFDPWLVAEAEKEGVECIPGATVDALYEENGRVCGVICGDDILRARYVVLAEGANSVLAERHGLVTRPAGEAMALGIKEVLSLETSAIEERFHLENNEGAALLFSGRICDDLPGGAFLYTNQQTLSLGIVCPLSSLTQSRVPASELLTRFKAHPAVRPLIKNTESLEYGAHLVPEGGLHSMPVQYAGNGWLLVGDALRSCVNTGISVRGMDMALTGAQAAAQTLISACQHREPQNLFPLYHHNVERSLLWDVLQRYQHVPALLQRPGWYRTWPALMQDISRDLWDQGDKPVPPLRQLFWHHLRRHGLWHLAGDVIRSLRCL

SEQ ID NO: 413 - protein, 98 aa, Escherichia coli
MASGGRCYQESAMSVARNLWRVADAPHIVPADSVERQTAERLINACPAGLFSLTPEGNLRIDYRSCLECGTCRLLCDESTLQQWRYPPSGFGITYRFG

SEQ ID NO: 414 - protein, 191 aa, Escherichia coli
MPLLHLLRQNPVIAAVKDNASLQLAIDSECQFISVLYGNICTISNIVKKIKNAGKYAFIHVDLLEGASNKEVVIQFLKLVTEADGIISTKASMLKAARAEGFFCIHRLFIVDSISFHNIDKQVAQSNPDCIEILPGCMPKVLGWVTEKIRQPLIAGGLVCDEEDARNAINAGVVALSTTNTGVWTLAKKLL

SEQ ID NO: 415 - protein, 134 aa, Escherichia coli
MFMTWEYALIGLVVGIIIGAVAMRFGNRKLRQQQALQYELEKNKAELDEYREELVSHFARSAELLDTMAHDYRQLYQHMAKSSSSLLPELSAEANPFRNRLAESEASNDQAPVQMPRDYSEGASGLLRTGAKRD

SEQ ID NO: 416 - protein, 455 aa, Escherichia coli
MKKQTQLLSALALSVGLTLSASFQAVASIPGQVADQAPLPSLAPMLEKVLPAVVSVRVEGTASQGQKIPEEFKKFFGDDLPDQPAQPFEGLGSGVIINASKGYVLTNNHVINQAQKISIQLNDGREFDAKLIGSDDQSDIALLQIQNPSKLTQIAIADSDKLRVGDFAVAVGNPFGLGQTATSGIVSALGRSGLNLEGLENFIQTDASINRGNSGGALLNLNGELIGINTAILAPGGGSVGIGFAIPSNMARTLAQQLIDFGEIKRGLLGIKGTEMSADIAKAFNLDVQRGAFVSEVLPGSGSAKAGVKAGDIITSLNGKPLNSFAELRSRIATTEPGTKVKLGLLRNGKPLEVEVTLDTSTSSSASAEMITPALEGATLSDGQLKDGGKGIKIDEVVKGSPAAQAGLQKDDVIIGVNRDRVNSIAEMRKVLAAKPAIIALQIVRGNESIYLLMR

SEQ ID NO: 417 - protein, 355 aa, Escherichia coli
MFVKLLRSVAIGLIVGAILLVAMPSLRSLNPLSTPQFDSTDETPASYNLAVRRAAPAVVNVYNRGLNTNSHNQLEIRTLGSGVIMDQRGYIITNKHVINDADQIIVALQDGRVFEALLVGSDSLTDLAVLKINATGGLPTIPINARRVPHIGDVVLAIGNPYNLGQTITQGIISATGRIGLNPTGRQNFLQTDASINHGNSGGALVNSLGELMGINTLSFDKSNDGETPEGIGFAIPFQLATKIMDKLIRDGRVIRGYIGIGGREIAPLHAQGGGIDQLQGIVVNEVSPDGPAANAGIQVNDLIISVDNKPAISALETMDQVAEIRPGSVIPVVVMRDDKQLTLQVTIQEYPATN

SEQ ID NO: 418 - protein, 118 aa, Escherichia coli; identical to SEQ ID NO: 386

SEQ ID NO: 419 - protein, 129 aa, Escherichia coli; identical to SEQ ID NO: 387

SEQ ID NO: 420 - protein, 206 aa, Escherichia coli; identical to SEQ ID NO: 388

SEQ ID NO: 421 - protein, 329 aa, Escherichia coli [sequence omitted]

SEQ ID NO: 422 - protein, 127 aa, Escherichia coli [sequence omitted]

SEQ ID NO: 423 - protein, 46 aa, Escherichia coli [sequence omitted]

SEQ ID NO: 424 - protein, 119 aa, Escherichia coli
MVKLAFPRELRLLTPSQFTFVFQQPQRAGTPQITILGRLNSLGHPRIGLTVAKKNVRRAHERNRIKRLTRESFRLRQHELPAMDFVVVAKKGVADLDNRALSEALEKLWRRHCRLARGS

SEQ ID NO: 425 - protein, 591 aa, Escherichia coli
MIEKLRNIAIIAHVDHGKTTLVDKLLQQSGTFDSRAETQERVMDSNDLEKERGITILAKNTAIKWNDYRINIVDTPGHADFGGEVERVMSMVDSVLLVVDAFDGPMPQTRFVTKKAFAYGLKPIVVINKVDRPGARPDWVVDQVFDLFVNLDATDEQLDFPIVYASALNGIAGLDHEDMAEDMTPLYQAIVDHVPAPDVDLDGPFQMQISQLDYNSYVGVIGIGRIKRGKVKPNQQVTIIDSEGKTRNAKVGKVLGHLGLERIETDLAEAGDIVAITGLGELNISDTVCDTQNVEALPALSVDEPTVSMFFCVNTSPFCGKEGKFVTSRQILDRLNKELVHNVALRVEETEDADAFRVSGRGELHLSVLIENMRREGFELAVSRPKVIFREIDGRKQEPYENVTLDVEEQHQGSVMQALGERKGDLKNMNPDGKGRVRLDYVIPSRGLIGFRSEFMTMTSGTGLLYSTFSHYDDVRPGEVGQRQNGVLISNGQGKAVAFALFGLQDRGKLFLGHGAEVYEGQIIGIHSRSNDLTVNCLTGKKLTNMRASGTDEAVVLVPPIRMTLEQALEFIDDDELVEVTPTSIRIRKRH

SEQ ID NO: 426 - protein, 756 aa, Escherichia coli
MMKVLIVESEFLHQDTWVGNAVERLADALSQQNVTVIKSTSFDDGFAILSSNEAIDCLMFSYQMEHPDEHQNVRQLIGKLHERQQNVPVFLLGDREKALAAMDRDLLELVDEFAWILEDTADFIAGRAVAAMTRYRQQLLPPLFSALMKYSDIHEYSWAAPGHQGGVGFTKTPAGRFYHDYYGENLFRTDMGIERTSLGSLLDHTGAFGESEKYAARVFGADRSWSVVVGTSGSNRTIMQACMTDNDVVVVDRNCHKSIEQGLMLTGAKPVYMVPSRNRYGIIGPIYPQEMQPETLQKKISESPLTKDKAGQKPSYCVVTNCTYDGVCYNAKEAQDLLEKTSDRLHFDEAWYGYARFNPIYADHYAMRGEPGDHNGPTVFATHSTHKLLNALSQASYIHVREGRGAINFSRFNQAYMMHATTSPLYAICASNDVAVSMMDGNSGLSLTQEVIDEAVDFRQAMARLYKEFTADGSWFFKPWNKEVVTDPQTGKTYDFADAPTKLLTTVQDCWVMHPGESWHGFKDIPDNWSMLDPIKVSILAPGMGEDGELEETGVPAALVTAWLGRHGIVPTRTTDFQIMFLFSMGVTRGKWGTLVNTLCSFKRHYDANTPLAQVMPELVEQYPDTYANMGIHDLGDTMFAWLKENNPGARLNEAYSGLPVAEVTPREAYNAIVDNNVELVSIENLPGRIAANSVIPYPPGIPMLLSGENFGDKNSPQVSYLRSLQSWDHHFPGFEHETEGTEIIDGIYHVMCVKA

SEQ ID NO: 427 - protein, 253 aa, Escherichia coli
MRICSDQPCIVLLTEKDVWIRVNGKEPISLKANHMALLNCENNIIDVSSLNNTLVAHISHDIIKDYLRFLNKDLSQIPVWQRSATPILTLPCLTPDVFRVAAQHSMMPAETESEKERTRALLFTVLSRFLDSKKFVSLMMYMLRNCVSDSVYQIIESDIHKDWNLSMVASCLCLSPSLLKKKLKSENTSYSQIITTCRMRYAVNELMMDGKNISQVSQSCGYNSTSYFISVFKDFYGMTPLHYVSQHRERTVA

SEQ ID NO: 428 - protein, 425 aa, Escherichia coli
MLRLPNIYFKGYIRITQETNMATAWYKQVNPPQRKALFSAWLGYVFDGFDFMMIFYILHIIKADLGITDIQATLIGTVAFIARPIGGGFFGAMADKYGRKPMMMWAIFIYSVGTGLSGIATNLYMLAVCRFIVGLGMSGEYACASTYAVESWPKNLQSKASAFLVSGFSVGNIIAAQIIPQFAEVYGWRNSFFIGLLPVLLVLWIRKSAPESQEWIEDKYKDKSTFLSVFRKPHLSISMIVFLVCFCLFGANWPINGLLPSYLADNGVNTVVISTLMTIAGLGTLTGTIFFGFVGDKIGVKKAFVVGLITSFIFLCPLFFISVKNSSLIGLCLFGLMFTNLGIAGLVPKFIYDYFPTKLRGLGTGLIYNLGATGGMAAPVLATYISGYYGLGVSLFIVTVAFSALLILLVGFDIPGKIYKLSVAK

SEQ ID NO: 429 - protein, 377 aa, Escherichia coli
MIGGFMINYGVVGVGYFGAELARFMNMHDNAKITCVYDPENGENIARELQCINMSSLDALVSSKLVDCVIVATPNYLHKEPVIKAAKNKKHVFCEKPIALSYEDCVDMVKACKEAGVTFMAGHIMNFFNGVQYARKLIKEGVIGEILSCHTKRNGWENKQERLSWKKMKEQSGGHLYHHIHELDCVQHLLGEIPETVTMIGGNLAHSGPGFGNEDDMLFMTLEFPSGKLATLEWGSAFNWPEHYVIINGTKGSIKIDMQETAGSLRIGGQTKHFLVHETQEEDDDRRKGNMTSEMDGAIAYGHPGKKTPLWLASLIRKETLFLHNILCGAKPEEDYIDLLNGEAAMSAIATADAATLSRSQDRKVKISEIIKHTSVM

SEQ ID NO: 430 - protein, 464 aa, Escherichia coli
MSAGKLPEGWVIAPVSTVTTLIRGVTYKKEQAINYLKDDYLPLIRANNIQNGKFDTTDLVFVPKNLVKESQKISPEDIVIAMSSGSKSVVGKSAHQHLPFECSFGAFCGVLRPEKLIFSGFIAHFTKSSLYRNKISSLSAGANINNIKPASFDLINIPIPPLAEQKIIAEKLDTLLAQVDSTKARFEQIPQILKRFRQAVLGGAVNGKLTEKWRNFEPQHSVFKKLNFESILTELRNGLSSKPNESGVGHPILRISSVRAGHVDQNDIRFLECSESELNRHKLQDGDLLFTRYNGSLEFVGVCGLLKKLQHQNLLYPDKLIRARLTKDALPEYIEIFFSSPSARNAMMNCVKTTSGQKGISGKDIKSQVVLLPPVKEQAEIVRRVEQLFAYADTIEKQVNNALARVNNLTQSILAKAFRGELTAQWRAENPDLISGENSAAALLEKIKAERAASGGKKASRKKS

SEQ ID NO: 431 - protein, 529 aa, Escherichia coli
MNNNDLVAKLWKLCDNLRDGGVSYQNYVNELASLLFLKMCKETGQEAEYLPEGYRWDDLKSRIGQEQLQFYRKMLVHLGEDDKKLVQAVFHNVSTTITEPKQITALVSNMDSLDWYNGAHGKSRDDFGDMYEGLLQKNANETKSGAGQYFTPRPLIKTIIHLLKPQPREVVQDPAAGTAGFLIEADRYVKSQTNDLDDLDGDTQDFQIHRAFIGLELVPGTRRLALMNCLLHDIEGNLDHGGAIRLGNTLGSDGENLPKAHIVATNPPFGSAAGTNITRTFVHPTSNKQLCFMQHIIETLHPGGRAAVVVPDNVLFEGGKGTDIRRDLMDKCHLHTILRLPTGIFYAQGVKTNVLFFTKGTVANPNQDKNCTDDVWVYDLRTNMPSFGKRTPFTDEHLQPFERVYGEDPHGLSPRTEGEWSFNAEETEVADSEENKNTDQHLATSRWRKFSREWIRTAKSDSLDISWLKDKDSIDADSLPEPDVLAAEAMGELVQALSELDALMRELGASDEADLQRQLLEEAFGGVKE

SEQ ID NO: 432 - protein, 98 aa, Escherichia coli
MKKENYSFKQACAVVGGQSAMARLLGVSPPSVNQWIKGVRQLPAERCPAIERATRGEVLCEELRPDIDWSYLRRSACCSQNMSVKQLNDSNKSSFDHT

SEQ ID NO: 433 - protein, 140 aa, Escherichia coli
MKIKHEHIESVLFALAAEKGQAWVANAITEEYLRQGGGELPLVPGKDWNNQQNIYHRWLKGETKTQREKIQKLIPAILAILPRELRHRLCIFDTLERRALLAAQEALSTAIDAHDDAVQAVYRKAHFSGGGSSDDSVIVH

SEQ ID NO: 434 - protein, 285 aa, Escherichia coli
MLFVLILSHRAASYGAIMAALPYMQLYIADYLADTMHLSAEEHGAYLLLMFNYWQTGKPIPKNRLAKIARLTNERWADVEPSLQEFFCDNGEEWVHLRIEEDLASVREKLTKKSAAGKASVQARRSRKEADVQTKQERNLTGVQTDVEVVFEHDVNTKATNKDTDKDLKTDPPLNPPRGNRGVKKFDPLDITLPNWISVSLWREWVEFRQALRKPIRTEQGANGAIRELEKFRQQGFSPEQVIRHSIANEYQGLFAPKGVRPETLLRQVNTVSLPDSAIPPGFRG

SEQ ID NO: 435 - protein, 248 aa, Escherichia coli
MKNIATGDVLERIRRLAPSHVTAPFKTVAEWREWQLSEGQKRCEEINRQNRQLRVEKILNRSGIQPLHRKCSFSNYQVQNEGQRYALSQAKSIADELMTGCTNFAFSGKPGTGKNHLAAAIGNRLLKDGQTVIVVTVADVMSALHASYDDGQSGEKFLRELCEVDLLVLDEIGIQRETKNEQVVLHQIVDRRTASMRSVGMLTNLNYEAMKTLLGERIMDRMTMNGGRWVNFNWESWRPNVVQPGIAK

SEQ ID NO: 436 - protein, 203 aa, Escherichia coli
MSSSQELRSNFYREKNLMETVFDALKAMGKATSIELAARLDISREEVLNELWELKKAGFVDKSAYTWRVADNNVQQEQPAQAELPEEITTATVAKISECDLTATIEQRGPQTADELATLFGTTSRKVASTLAMAISKGRLIRVNQGGKFRYCIPGDNLPAEPKAASVSPLWLSASSSACHGVLIITVITPSPTKNSATKMPEN

SEQ ID NO: 437 - protein, 101 aa, Escherichia coli
MQMRQRDVAALDAKYTKELADAKAENDALRDDVAAGRRRLHIKAVCQSVREATTASGVDNAASPRLADTAERDYFTLRERLVMMQAQLEGAQQYITEQCLK

SEQ ID NO: 438 - protein, 292 aa, Escherichia coli
MKLGFIGLGIMGTPMAINLARAGHQLHVTTIGPVADELLSLGAVSVETARQVTEASDIIFIMVPDTPQVEEVLFGENGCTKASLKGKTIVDMSSISPIETKRFARQVNELGGDYLDAPVSGGEIGAREGTLSIMVGGDEAVFERVKPLFELLGKNITLVGGNGDGQTCKVANQIIVALNIEAVSEALLFASKAGADPVRVRQALMGGFASSRILEVHGERMIKRTFNPGFKIALHQKDLNLALQSAKALALNLPNTATCQELFNTCAANGGSQLDHSALVQALELMANHKLA

SEQ ID NO: 439 - protein, 92 aa, Escherichia coli
MNRPAILKKKAAKDVASVLKIIFLFYLFLIARLKQRYSIREIKRDLWNIRENYSSNAAIAKIYCRKRKASGPGKHLTILPYGWVRFITFPIM

SEQ ID NO: 440 - protein, 437 aa, Escherichia coli
MVGGFFILGLSTFSIMLAIILSAFFIAAVMVLNGAAGSKYGVPFAMILRASYGVRGALFPGLLRGGIAAIMWFGLQCYAGSLACLILIGKIWPGFLTLGGDFTLLGLSLPGLITFLIFWLVNVGIGFGGGKVLNKFTAILNPCIYIVFGGMAIWAISLVGIGPIFDYIPSGIQKAENGGFLFLVVINAVVAVWAAPAVSASDFTQNAHSFREQALGQTLGLVVAYILFAVAGVCIIAGASIHYGADTWNVLDIVQRWDSLFASFFAVLVILMTTISTNATGNIIPAGYQIAAIAPTKLTYKNGVLIASIISLLICPWKLMENQDSIYLFLDIIGGMLGPVIGVMMAHYFVVMRGQINLDELYTAPGDYKYYDNGFNLTAFSVTLVAVILSLGGKFIHFMEPLSRVSWFVGVIVAFAAYALLKKRTTAEKTGEQKTIG

SEQ ID NO: 441 - protein, 464 aa, Escherichia coli
MLLLDACSQMCPSFRRFQTVFHNSSIFLPYWLATLVSFRETFQEEKLLTMKGSYKSRWVIVIVVVIAAIAAFWFWQGRNDSRSAAPGATKQAQQSPAGGRRGMRSGPLAPVQAATAVEQAVPRYLTGLGTITAANTVTVRSRVDGQLIALHFQEGQQVKAGDLLAEIDPSQFKVALAQAQGQLAKDKATLANARRDLARYQQLAKTNLVSRQELDAQQALVSETEGTIKADEASVASAQLQLDWSRITAPVDGRVGLKQVDVGNQISSGDTTGIVVITQTHPIDLVFTLPESDIATVVQAQKAGKPLVVEAWDRTNSKKLSEGTLLSLDNQIDATTGTIKVKARFNNQDDALFPNQFVNARMLVDTEQNAVVIPTAALQMGNEGHFVWVLNSENKVSKHLVTPGIQDSQKVVIRAGISAGDRVVTDGIDRLTEGAKVEVVEAQSATTPEEKATSREYAKKGARS

SEQ ID NO: 442 - protein, 1040 aa, Escherichia coli
MQVLPPSSTGGPSRLFIMRPVATTLLMVAILLAGIIGYRALPVSALPEVDYPTIQVVTLYPGASPDVMTSAVTAPLERQFGQMSGLKQMSSQSSGGASVITLQFQLTLPLDVAEQEVQAAINAATNLLPSDLPNPPVYSKVNPADPPIMTLAVTSTAMPMTQVEDMVETRVAQKISQISGVGLVTLSGGQRPAVRVKLNAQAIAALGLTSETVRTAITGANVNSAKGSLDGPSRAVTLSANDQMQSAEEYRQLIIAYQNGAPIRLGDVATVEQGAENSWLGAWANKEQAIVMNVQRQPGANIISTADSIRQMLPQLTESLPKSVKVTVLSDRTTNIRASVDDTQFELMMAIALVVMIIYLFLRNIPATIIPGVAVPLSLIGTFAVMVFLDFSINNLTLMALTIATGFVVDDAIVVIENISRYIEKGEKPLAAALKGAGEIGFTIISLTFSLIAVLIPLLFMGDIVGRLFREFAITLAVAILISAVVSLTLTPMMCARMLSQESLRKQNRFSRASEKMFDRIIAAYGRGLAKVLNHPWLTLSVALSTLLLSVLLWVFIPKGFFPVQDNGIIQGTLQAPQSSSFANMAQRQRQVADVILQDPAVQSLTSFVGVDGTNPSLNSARLQINLKPLDERDDRVQKVIARLQTAVDKVPGVDLFLQPTQDLTIDTQVSRTQYQFTLQATSLDALSTWVPQLMEKLQQLPQLSDVSSDWQDKGLVAYVNVDRDSASRLGISMADVDNALYNAFGQRLISTIYTQANQYRVVLEHNTENTPGLAALDTIRLTSSDGGVVPLSSIAKIEQRFAPLSINHLDQFPVTTISFNVPDNYSLGDAVQAIMDTEKTLNLPVDITTQFQGSTLAFQSALGSTVWLIVAAVVAMYIVLGILYESFIHPITILSTLPTAGVGALLALLIAGSELDVIAIIGIILLIGIVKKNAIMMIDFALAAEREQGMSPREAIYQACLLRFRPILMTTLAALLGALPLMLSTGVGAELRRPLGIGMVGGLIVSQVLTLFTTPVIYLLFDRLALWTKSRFARHEEEA

SEQ ID NO: 443 - protein, 1025 aa, Escherichia coli
MKFFALFIYRPVATILLSVAITLCGILGFRMLPVAPLPQVDFPVIIVSASLPGASPETMASSVATPLERSLGRIAGVSEMTSSSSLGSTRIILQFDFDRDINGAARDVQAAINAAQSLLPSGMPSRPTYRKANPSDAPIMILTLTSDTYSQGELYDFASTQLAPTISQIDGVGDVDVGGSSLPAVRVGLNPQALFNQGVSLDDVRTAVSNANVRKPQGALEDGTHRWQIQTNDELKTAAEYQPLIIHYNNGGAVRLGDVATVTDSVQDVRNAGMTNAKPAILLMIRKLPEANIIQTVDSIRAKLPELQETIPAAIDLQIAQDRSPTIRASLEEVEQTLIISVALVILVVFLFLRSGRATIIPAVSVPVSLIGTFAAMYLCGFSLNNLSLMALTIATGFVVDDAIVVLENIARHLEAGMKPLQAALQGTREVGFTVLSMSLSLVAVFLPLLLMGGLPGRLLREFAVTLSVAIGISLLVSLTLTPMMCGWMLKASKPREQKRLRGFGRMLVALQQGYGKSLKWVLNHTRLVGVVLLGTIALNIWLYISIPKTFFPEQDTGVLMGGIQADQSISFQAMRGKLQDFMKIIRDDPAVDNVTGFTGGSRVNSGMMFITLKPRDERSETAQQIIDRLRVKLAKEPGANLFLMAVQDIRVGGRQSNASYQYTLLSDDLAALREWEPKIRKKLATLPELADVNSDQQDNGAEMNLVYDRDTMARLGIDVQAANSLLNNAFGQRQISTIYQPMNQYKVVMEVDPRYTQDISALEKMFVINNEGKAIPLSYFAKWQPANAPLSVNHQGLSAASTISFNLPTGKSLSDASAAIDRAMTQLGVPSTVRGSFAGTAQVFQETMNSQVILIIAAIATVYIVLGILYESYVHPLTILSTLPSAGVGALLALELFNAPFSLIALIGIMLLIGIVKKNAIMMVDFALEAQRHGNLTPQEAIFQACLLRFRPIMMTTLAALFGALPLVLSGGDGSELRQPLGITIVGGLVMSQLLTLYTTPVVYLFFDRLRLRFSRKPKQTVTE

SEQ ID NO: 444 - protein, 471 aa, Escherichia coli
MTDLPDSTRWQLWIVAFGFFMQSLDTTIVNTALPSMAQSLGESPLHMHMVIVSYVLTVAVMLPASGWLADKVGVRNIFFTAIVLFTLGSLFCALSGTLNELLLARALQGVGGAMMVPVGRLTVMKIVPREQYMAAMTFVTLPGQVGPLLGPALGGLLVEYASWHWIFLINIPVGIIGAIATLLLMPNYTMQTRRFDLSGFLLLAVGMAVLTLALDGSKGTGLSPLTIAGLVAVGVVALVLYLLHARNNNRALFSLKLFRTRTFSLGLAGSFAGRIGSGMLPFMTPVFLQIGLGFSPFHAGLMMIPMVLGSMGMKRIVVQVVNRFGYRRVLVATTLGLSLVTLLFMTTALLGWYYVLPFVLFLQGMVNSTRFSSMNTLTLKDLPDNLASSGNSLLSMIMQLSMSIGVTIAGLLLGLFGSQHVSVDSGTTQTVFMYTWLSMALIIALPAFIFARVPNDTHQNVAISRRKRSAQ

SEQ ID NO: 445 - protein, 138 aa, Escherichia coli
MIAFEVLKWAGAAYLIWLGIQQWRAAGAIDLKSLASTQSRRHLFQRAVFVNLTNPKSIVFLAALFPQFIMPQQPQLMQYIVLGVTTIVVDIIVMIGYATLAQRIALWIKGPKQMKALNKIFGSLFMLVGALLASARHA

SEQ ID NO: 446 - protein, 257 aa, Escherichia coli
MARKWLNLFAGAALSFAVAGNALADEGKITVFAAASLTNAMQDIATQFKKEKGVDVVSSFASSSTLARQIEAGAPADLFISADQKWMDYAVDKKAIDTATRQTLLGNSLVVVAPKASVQKDFTIDSKTNWTSLLNGGRLAVGDPEHVPAGIYAKEALQKLGAWDTLSPKLAPAEDVRGALALVERNEAPLGIVYGSDAVASKGVKVVATFPEDSHKKVEYPVAVVEGHNNATVKAFYDYLKGPQAAEIFKRYGFTIK

SEQ ID NO: 447 - protein, 229 aa, Escherichia coli
MILTDPEWQAVLLSLKVSSLAVLFSLPFGIFFAWLLVRCTFPGKALLDSVLHLPLVLPPVVVGYLLLVSMGRRGFIGERLYDWFGITFAFSWRGAVLAAAVMSFPLMVRAIRLALEGVDVKLEQAARTLGAGRWRVFFTITLPLTLPGIIVGTVLAFARSLGEFGATITFVSNIPGETRTIPSAMYTLIQTPGGESGAARLCIISIALAMISLLISEWLARISRERAGR

SEQ ID NO: 448 - protein, 352 aa, Escherichia coli
MLELNFSQTLGNHCLTINETLPANGITAIFGVSGAGKTSLINAISGLTRPQKGRIVLNGRVLNDAEKGICLTPEKRRVGYVFQDARLFPHYKVRGNLRYGMSKSMVDQFDKLVALLGIEPLLDRLPGSLSGGEKQRVAIGRALLTAPELLLLDEPLASLDIPRKRELLPYLQRLTREINIPMLYVSHSLDEILHLADRVMVLENGQVKAFGALEEVWGSSVMNPWLPKEQQSSILKVTVLEHHPHYAMTALALGDQHLWVNKLDEPLQAALRIRIQASDVSLVLQPPQQTSIRNVLRAKVVNSYDDNGQVEVELEVGGKTLWARISPWARDELAIKPGLWLYAQIKSVSITA

SEQ ID NO: 449 - protein, 168 aa, Escherichia coli
MNSVITQKVSSGVTLYADTKTGGFMNRTILVPIDISDSELTQRVISHVEEEAKIDDAEVHFLTVIPSLPYYASLGLAYSAELPAMDDLKAEAKSQLEEIIKKFKLPTDRVHVHVEEGSPKDRILELAKKIPAHMIIIASHRPDITTYLLGSNAAAVVRHAECSVLVVR

SEQ ID NO: 450 - protein, 377 aa, Escherichia coli
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADIGATYYFNKNMSTYVDYKINLLDEDDSFYAANGISTDDIVALGLVYQF

SEQ ID NO: 451 - protein, 1122 aa, Escherichia coli
MLRVYHSNRLDVLEALMEFIVERERLDDPFEPEMILVQSTGMAQWLQMTLSQKFGIAANIDFPLPASFIWDMFVRVLPEIPKESAFNKQSMSWKLMTLLPQLLEREDFTLLRHYLTDDSDKRKLFQLSSKAADLFDQYLVYRPDWLAQWETGHLVEGLGEAQAWQAPLWKALVEYTHQLGQPRWHRANLYQRFIETLESATTCPPGLPSRVFICGISALPPVYLQALQALGKHIEIHLLFTNPCRYYWGDIKDPAYLAKLLTRQRRHSFEDRELPLFRDSENAGQLFNSDGEQDVGNPLLASWGKLGRDYIYLLSDLESSQELDAFVDVTPDNLLHNIQSDILELENRAVAGVNIEEFSRSDNKRPLDPLDSSITFHVCHSPQREVEVLHDRLLAMLEEDPTLTPRDIIVMVADIDSYSPFIQAVFGSAPADRYLPYAISDRRARQSHPVLEAFISLLSLPDSRFVSEDVLALLDVPVLAARFDITEEGLRYLRQWVNESGIRWGIDDDNVRELELPATGQHTWRFGLTRMLLGYAMESAQGEWQSVLPYDESSGLIAELVGHLASLLMQLNIWRRGLAQERPLEEWLPVCRDMLNAFFLPDAETEAAMTLIEQQWQAIIAEGLGAQYGDAVPLSLLRDELAQRLDQERISQRFLAGPVNICTLMPMRSIPFKVVCLLGMNDGVYPRQLAPLGFDLMSQKPKRGDRSRRDDDRYLFLEALISAQQKLYISYIGRSIQDNSERFPSVLVQELIDYIGQSHYLPGDEALNCDESEARVKAHLTCLHTRMPFDPQNYQPGERQSYAREWLPAASQAGKAHSEFVQPLPFTLPETVPLETLQRFWAHPVRAFFQMRLQVNFRTEDSEIPDTEPFILEGLSRYQINQQLLNALVEQDDAERLFRRFRAAGDLPYGAFGEIFWETQCQEMQQLADRVIACRQPGQSMEIDLACNGVQITGWLPQVQPDGLLRWRPSLLSVAQGMQLWLEHLVYCASGGNGESRLFLRKDGEWRFPPLAAEQALHYLSQLIEGYREGMSAPLLVLPESGGAWLKTCYDAQNDAMLDDDSTLQKARTKFLQAYEGNMMVRGEGDDIWYQRLWRQLTPETMEAIVEQSQRFLLPLFRFNQS

SEQ ID NO: 452 - protein, 107 aa, Escherichia coli
MSASLKNQQGFSLPEVMLAMVLMVMIVTALSGFQRTLMNSLASRNQYQQLWRHGWQQTQLRAISPPANWQVNRMQTSQAGCVSISVTLVSPGGREGEMTRLHCPNRQ

SEQ ID NO: 453 - protein, 121 aa, Escherichia coli
MLLVLGSLLLQGMSQQDRSFASRVSMESQSLRRQAIVQSALAWGKMHCWQTQPAVQCSQYAETDAQVCLRLLADNEALLIAGYEGVSLWRTGEVIDGNIVFSPRGWSDFCPLKERALCQLP

SEQ ID NO: 454 - protein, 187 aa, Escherichia coli
MPVKEQGFSLLEVLIAMAISSVLLLGAARFLPALQRESLTSTRKLALEDEIWLRVFTVAKHLQRAGYCHGICTGEGLEIVGQGDCVIVQWDANSNGIWDREPVKESDQIGFRLKEHVLETLRGATSCEGKGWDKVTNPDAIIIDTFQVVRQDVSGFSPVLTVNMRAASKSEPQTVVNASYSVTGFNL

SEQ ID NO: 455 - protein, 156 aa, Escherichia coli
MKTQRGYTLIETLVAMLILVMLSASGLYGWQYWQQSQRLWQTASQARDYLLYLREDANWHNRDHSISVIREGTLWCLVSSAAGANTCHGSSPLVFVPRWPEVEMSDLTPSLAFFGLRNTAWAGHIRFKNSTGEWWLVVSPWGRLRLCQQGETEGCL

SEQ ID NO: 456 - protein, 711 aa, Escherichia coli
MSTIVIFLAALLACSLLAGWLIKVRSRRRQLPWTNAFADAQTRKLTPEERSAVENYLESLTQVLQVPGPTGASAAPISLALNAESNNVMMLTHAITRYGISTDDPNKWRYYLDSVEVHLPPFWEQYINDENTVELIHTDSLPLVISLNGHTLQEYMQETRSYALQPVPSTQASIRGEESEQIELLNIRKETHEEYALSRPRGLREALLIVASFLMFFFCLITPDVFVPWLAGGALLLLGAGLWGLFAPPAKSSLREIHCLRGTPRRWGLFGENDQEQINNISLGIIDLVYPAHWQPYIAQDLGQQTDIDIYLDRHVVRQGRYLSLHDEVKNFPLQHWLRSTIIAAGSLLVLFMLLFWIPLDMPLKFTLSWMKGAQTIEATSVKQLADAGVRVGDTLRISGTGMCNIRTSGTWSAKTNSPFLPFDCSQIIWNDARSLPLPESELVNKATALTEAVNRQLHPKPEDESRVSASLRSAIQKSGMVLLDDFGDIVLKTADLCSAKDDCVRLKNALVNLGNSKDWDALVKRANAGKLDGVNVLLRPVSAESLDNLVATSTAPFITHETARAAQSLNSPAPGGFLIVSDEGSDFVDQPWPSASLYDYPPQEQWNAFQKLAQMLMHTPFNAEGIVTKIFTDANGTQHIGLHPIPDRSGLWRYLSTTLLLLTMLGSAIYNGVQAWRRYQRHRTRMMEIQAYYESCLNPQLITPSESLIE

SEQ ID NO: 457 - protein, 237 aa, Escherichia coli
MLPCRANCFTLEISLMHINIAWQDVDTVLLDMDGTLLDLAFDNYFWQKLVPETWGAKNGVTPQEAMEYMRQQYHDVQHTLNWYCLDYWSEQLGLDICAMTTEMGPRAVLREDTIPFLEALKASGKQRILLTNAHPHNLAVKLEHTGLDAHLDLLLSTHTFGYPKEDQRLWHAVAEATGLKAERTLFIDDSEAILDAAAQFGIRYCLGVTNPDSGIAEKQYQRHPSLNDYRRLIPSLM

SEQ ID NO: 458 - protein, 133 aa, Escherichia coli
MKEKPAVEVRLDKWLWAARFYKTRALAREMIEGGKVHYNGQRSKPSKIVELNATLTLRQGNDERTVIVKAITEQRRPASEAALLYEETAESVEKREKMALARKLNALTMPHPDRRPDKKERRDLLRFKHGDSE

SEQ ID NO: 459 - protein, 294 aa, Escherichia coli
MIMPQHDQLHRYLFENFAVRGELVTVSETLQQILENHDYPQPVKNVLAELLVATSLLTATLKFDGDITVQLQGDGPMNLAVINGNNNQQMRGVARVQGEIPENADLKTLVGNGYVVITITPSEGERYQGVVGLEGDTLAACLEDYFMRSEQLPTRLFIRTGDVDGKPAAGGMLLQVMPAQNAQQDDFDHLATLTETIKTEELLTLPANEVLWRLYHEEEVTVYDPQDVEFKCTCSRERCADALKTLPDEEVDSILAEDGEIDMHCDYCGNHYLFNAMDIAEIRNNASPADPQVH

SEQ ID NO: 460 - protein, 120 aa, Escherichia coli
MLKLFAKYTSIGVLNTLIHWVVFGVCIYVAHTNQALANFAGFVVAVSFSFFANAKFTFKASTTTMRYMLYVGFMGTLSATVGWAADRCALPPMITLVTFSAISLVCGFVYSKFIVFRDAK

SEQ ID NO: 461 - protein, 306 aa, Escherichia coli
MKISLVVPVFNEEEAIPIFYKTVREFEELKSYEVEIVFINDGSKDATESIINALAVSDPLVVPLSFTRNFGKEPALFAGLDHATGDAIIPIDVDLQDPIEVIPHLIEKWQAGADMVLAKRSDRSTDGRLKRKTAEWFYKLHNKISNPKIEENVGDFRLMSRDVVENIKLMPERNLFMKGILSWVGGKTDIVEYVRAERIAGDTKFNGWKLWNLALEGITSFSTFPLRIWTYIGLVVASVAFIYGAWMILDTIIFGNAVRGYPSLLVSILFLGGIQMIGIGVLGEYIGRTYIETKKRPKYIIKRVKK

SEQ ID NO: 462 - protein, 443 aa, Escherichia coli
MNKAIKVSLYISFVLIICALSKNIMMLNTSDFGRAIKPLIEDIPAFTYDLPLLYKLKGHIDSIDSYEYISSYSYILYTYVLFISIFTEYLDARVLSLFLKVIYIYSLYAIFTSYIKTERYVTLFTFFILAFLMCSSSTLSMFASFYQEQIVIIFLPFLVYSLTCKNNKSMLLLFFSLLIISTAKNQFILTPLIVYSYYIFFDRHKLIIKSVICVVCLLASIFAISYSKGVVELNKYHATYFGSYLYMKNNGYKMPSYVDDKCVGLDAWGNKFDISFGATPTEVGTECFESHKDETFSNALFLLVSKPSTIFKLPFDDGVMSQYKENYFHVYKKLHVIYGESNILTTITNIKDNIFKNIRFISLLLFFIASIFIRNNKIKASLFVVSLFGISQFYVSFFGEGYRDLSKHLFGMYFSFDLCLYITVVFLIYKIIQRNQDNSDVKH

SEQ ID NO: 463 - protein, 114 aa, Escherichia coli
MILDRHITSRGYVCMRPATIAPLTPYDKWDGEKWVTDTEAQHSVAVDAAEAQRQSLIDTAMASISLIQLKLQAGRKLMQAETSRLNTVLDYIDAVTATDTSTAPDVIWPELPEE

SEQ ID NO: 464 - protein, 148 aa, Escherichia coli
MKPRNINNSLPLQPLVPDQENKNKKNEEKSVNPVKITMGSGLNYIEQESLGGKYLTHDLSIKIADISEEIIQQAILSAMSIYKFSITDDLMSMAVNELIKLTKIENNVDLNKFTTICTDVLSPRVTRHNKEKNKRHSTLLKNPLFNFH

SEQ ID NO: 465 - protein, 167 aa, Escherichia coli
MPGNRPHYGRWPQHDFPPFKKLRPQSVTSRIQPGSDVIVCAEMDEQWGYVGAKSRQRWLFYAYDRLRKTVVAHVFGERTMATLGRLMSLLSPFDVVIWMTDGWPLYESRLKGKLHVISKRYTQRIERHNLNLRQHLARLGRKSLSFSKSVEQHDKVIGHYLNIKHYQ

SEQ ID NO: 466 - protein, 91 aa, Escherichia coli
MASVSISCPSCSATDGVVRNGKSTAGHQRYLCSHCRKTWQLQFTYTASQPGTHQKIIDMAMNGVGCRATARIMGVGLNTIFRHLKNSGRSR

SEQ ID NO: 467 - protein, 1377 aa, Escherichia coli
MSGKPAARQGDMTQYGGSIVQGSAGVRIGAPTGVACSVCPGGVTSGHPVNPLLGAKVLPGETDIALPGPLPFILSRTYSSYRTKTPAPVGSLGPGWKMPADIRLQLRDNTLILSDNGGRSLYFEHLFPGEDGYSRSESLWLVRGGVAKLDEGHRLAALWQALPEELRLSPHRYLATNSPQGPWWLLGWCERVPEADEVLPAPLPPYRVLTGLVDRFGRTQTFHREAAGEFSGEITGVTDGAWRHFRLVLTTQAQRAEEARQQAISGGTEPSAFPDTLPGYTEYGRDNGIRLSAVWLTHDPEYPENLPAAPLVRYGWTPRGELAVVYDRSGKQVRSFTYDDKYRGRMVAHRHTGRPEIRYRYDSDGRVTEQLNPAGLSYTYQYEKDRITITDSLDRREVLHTQGEAGLKRVVKKEHADGSVTQSQFDAVGRLRAQTDAAGRTTEYSPDVVTGLITRITTPDGRASAFYYNHHNQLTSATGPDGLELRREYDELGRLIQETAPDGDITRYRYDNPHSDLPCATEDATGSRKTMTWSRYGQLLSFTDCSGYVTRYDHDRFGQMTAVHREEGLSQYRAYDSRGQLIAVKDTQGHETRYEYNIAGDLTAVIAPDGSRNGTQYDAWGKAVRTTQGGLTRSMEYDAAGRVIRLTSENGSHTTFRYDVLDRLIQETGFDGRTQRYHHDLTGKLIRSEDEGLVTHWHYDEADRLTHRTVKGETAERWQYDERGWLTDISHISEGHRVAVHYRYDEKGRLTGERQTVHHPQTEALLWQHETRHAYNAQGLANRCIPDSLPAVEWLTYGSGYLAGMKLGDTPLVEYTRDRLHRETLRSFGRYELTTAYTPAGQLQSQHLNSLLSDRDYTWNDNGELIRISSPRQTRSYSYSTTGRLTGVHTTAANLDIRIPYATDPAGNRLPDPELHPDSTLSMWPDNRIARDAHYLYRYDRHGRLTEKTDLIPEGVIRTDDERTHRYHYDSQHRLVHYTRTQYEEPLVESRYLYDPLGRRVAKRVWRRERDLTGWMSLSRKPQVTWYGWDGDRLTTIQNDRTRIQTIYQPGSFTPLIRVETATGELAKTQRRSLADALQQSGGEDGGSVVFPPVLVQMLDRLESEILADRVSEESRRWLASCGLTVEQMQNQMDPVYTPARKIHLYHCDHRGLPLALISKEGTTEWCAEYDEWGNLLNEENPHQLQQLIRLPGQQYDEESGLYYNRHRYYDPLQGRYITQDPIGLKGGWNFYQYPLNPVTNTDPLGLEVFPRPFPLPIPWPKSPAQQQADDNAAKALTKWWNDTASQRIFDSLILNNPGLALDITMIASRGNVADTGITDRVNDIINDRFWSDGKKPDRCDVLQELIDCGDISAKDAKSTQKAWNCRHSRQSNDKKR

SEQ ID NO: 468 - protein, 280 aa, Escherichia coli
MSNTYQKRKASKEYGLYNQCKKLNDDELFRLLDDHNSLKRISSARVLQLRGGQDAVRLAIEFCSDKNYIRRDIGAFILGQIKICKKCEDNVFNILNNMALNDKSACVRATAIESTAQRCKKNPIYSPKIVEQSQITAFDKSTNVRRATAFAISVINDKATIPLLINLLKDPNGDVRNWAAFAININKYDNSDIRDCFVEMLQDKNEEVRIEAIIGLSYRKDKRVLSVLCDELKKNTVYDDIIEAAGELGDKTLLPVLDTMLYKFDDNEIITSAIDKLKRS

SEQ ID NO: 469 - protein, 233 aa, Escherichia coli
MQMLDRLESEILADRVSEESRRWLASCGLTVEQMKNQMDPVYTPARKIHLYHCDHRGLPLALISKEGTTEWCAEYDEWGNLLNEENPHQLQQLIRLPGQQYDEESGLYYNRHRYYDPLQGRYITQDPIGLKGGWNFYQYPLNPVINVDPQGLVDINLYPESDLIHSVADEINIPGVFTIGGHGTPTSIESATRSIMTAKDLAYLIKFDGNYKDGMTVWLFSCNTGKGQNSFAS

What is claimed is:

1. A method for identifying a compound which reduces the activity or level of a gene product required for proliferation of a microorganism, wherein the activity or expression of said gene product is inhibited by an antisense nucleic acid comprising SEQ ID NO: 25 said method comprising the steps of:
   (a) expressing a sublethal level of an antisense nucleic acid complementary to a nucleic acid encoding said gene product in a cell to reduce the activity or amount of said gene product in said cell, thereby producing a sensitized cell;
   (b) contacting said sensitized cell with a compound; and
   (c) determining whether said compound inhibits the growth of said sensitized cell.

2. The method of claim 1, wherein said determining step comprises determining whether said compound inhibits the growth of said sensitized cell to a greater extent than said compound inhibits the growth of a nonsensitized cell.

3. The method of claim 1, wherein said cell is selected from the group consisting of bacterial cells, fungal cells, plant cells, and animal cells.

4. The method of claim 1, wherein said cell is a Gram negative bacterium.

5. The method of claim 1, wherein said cell is an *E. coli* cell.

6. The method of claim 1, wherein said cell is from an organism selected from the group consisting of *Aspergillus fumigatus, Bacillus anthracis, Campylobacter jejuni, Candida albicans, Chlamydia pneumoniae, Chlamydia trachomatus, Clostridium botulinum, Cryptococcus neoformans, Enterobacter cloacae, Enterococcus faecalis, Haemophilus influenzae, Helicobacter pylori, Klebsiella pneumoniae, Mycobacterium leprae, Mycobacterium tuberculosis, Neisseria gonorrhoeae, Pseudomonas aeruginosa, Saccharomyces cerevisae, Salmonella cholerasuis, Salmonella paratyphi, Salmonella typhi, Salmonella typhimurium, Staphylococcus aureus, Staphylococcus epidermidis, Streptococcus pneumoniae, Treponcma pallidum*, and *Yersinia pestis* or any species falling within the genera of any of the above species.

7. The method of claim 1, wherein said antisense nucleic acid is transcribed from an inducible promoter.

8. The method of claim 7, further comprising the step of contacting said cell with a concentration of inducer which induces said antisense nucleic acid to a sublethal level.

9. The method of claim 1, wherein growth inhibition is measured by monitoring optical density of a culture growth solution.

10. The method of claim 1, wherein said gene product is a polypeptide.

11. The method of claim 1, wherein said polypeptide comprises SEQ ID NO: 345.

12. The method of claim 1, wherein said gene product is an RNA.

* * * * *

UNITED STATES PATENT AND TRADEMARK OFFICE
CERTIFICATE OF CORRECTION

PATENT NO. : 6,589,738 B1
DATED : July 8, 2003
INVENTOR(S) : R. Allyn Forsyth, Kari Ohlsen and Judith W. Zyskind It is certified that error appears in the above-identified patent and that said Letters Patent is hereby corrected as shown below:

<u>Title page,</u>
Item [57], ABSTRACT,
Lines 2 and 9, please replace "*E. Coli*" with -- *E. coli* --.

<u>Column 5,</u>
Line 36, please replace "AThe" with -- The --.

<u>Column 9,</u>
Line 43, please replace "1-27" with -- 1-127 --.

<u>Column 13,</u>
Line 2, please replace "hybridze" with -- hybridize --.

<u>Column 15,</u>
Line 8, please replace "includeds" with -- includes --.
Line 48, please replace "finctionally" with -- functionally --.

<u>Column 17,</u>
Line 35, please replace "." with -- --.

<u>Column 18,</u>
Line 56, please replace "Moraxala" with -- Moraxella --.

<u>Column 19,</u>
Line 57, please replace "Alschul" with -- Altschul --.

UNITED STATES PATENT AND TRADEMARK OFFICE
CERTIFICATE OF CORRECTION

PATENT NO. : 6,589,738 B1
DATED : July 8, 2003
INVENTOR(S) : R. Allyn Forsyth, Kari Ohlsen and Judith W. Zyskind It is certified that error appears in the above-identified patent and that said Letters Patent is hereby corrected as shown below:

Column 33,
Under MOLECULE NUMBER, please replace "EcXA966" with -- EcXA066 --.

Column 42,
Line 31, please replace "rpml" with -- rpmI --.

Column 48,
Line 59, please replace "5,574, 656" with -- 5,574,656 --.

Column 54,
Line 34, please replace "37 C" with -- 37° C --.

Column 58,
Line 10, please replace "$OD_{600}$" with -- OD600 --.

Column 61,
Line 18, please replace "finction" with -- function --.

Column 68,
Line 15, under RESISTANT MUTANTS, replace "ptsl" with -- ptsI --.

Column 76,
Line 17, please replace "Camplvbacter" with -- Camplyobacter --.

Signed and Sealed this

Fourteenth Day of October, 2003

JAMES E. ROGAN
*Director of the United States Patent and Trademark Office*